United States Patent 7,745,391 (HUMAN THROMBOSPONDIN POLYPEPTIDE) - sequence listing, part 3

SEQ ID NO: 5778 - DNA, 520 bp, Homo sapiens
aaatacaccacatgtgtgaaaggcatggttcaactgttctggcctacaatacaccactgctgcgtcattatccaccagcctgtaaaaaacaatatacctgtcacaacagacgccacaacatttcttctctcactcgtcaatacattcacattctggccattgaaaattatctaggaagactgccattttctacttcttaagcataaatttttcattaaatgctgtatccccacttcctcaaacacccacgcggacttcaggcatgtgcacaaggaagactgctgctccgcagtctgggccggcatcctccagctccacctcagccttgggagcccacaatgttctatttttatttgatcccatctgcttccagcaatcactgaaaagaaacagcctttaccaaacactccaaaatgtctttgtggtgacgtcattaggaactcataactgtccccaggaattcgcagtgggaacaaaggttttcaggaatattctcagctcaccaagcttgcacattatc

SEQ ID NO: 5779 - DNA, 314 bp, Homo sapiens
gacaaagaggtgagaagtgggatttagggtgtatttcaaaagtagaggcagtaagatttcctgatggacaaaatgggggcttgagaaaagagaatgcaaggctggtgccaccactaggggaccaggggccccaagagctgaaaggttagagctgtctacctcacccacacagcatccagaaataaataaataaataaatacattttccccagctccagcttaaaggacagaaagatcatttaaaagtgaaacctctgccaggtgcagaggctcactccagcctgggcaacagagcaagattctgtctcaaaaaa

SEQ ID NO: 5780 - DNA, 294 bp, Homo sapiens
gacaaagaggtgagaagtgggatttagggtgtatttcaaaagtagaggcagtaagatttcctgatggacaaaatgggggcttgagaaaagagaatgcaaggctggtgccaccactaggggaccaggggccccaagagctgaaaggttagagctgtctacctcacccacacagcatccagaaataaataaataaataaataaataaaatgtaaacctaaaaagcaacgggaattctgacacatgcgctacatagctgagctttaagctcctgtgctaactgaaatcaaccatatg

SEQ ID NO: 5781 - DNA, 445 bp, Homo sapiens
agctccctcccactcacacttgattggccaaagcaagtcacatgacactgcttacctgcaagggggcagggaggtgcaacgctactaagtgcccgggagagggagaactgcaatttcttggcaagcggcaaaagataaccacagggtactgtttcatcaagggccgcccaaagccctgtctgaatatggggctcgtgtttcccctgctatgtagttacacaggcctcctgcagcttagtttcagcttttctagtttttcatggctcccagagggaatattttctatgccgtatagcctgttttcacatgaagccattttggggtgttatagtaacagctggtgacttgattttatttatgttgctatgtgctgaaagctttatgaatgttctggctgtgccagttactagctgtgggacatggaacaagttatgaacaacctatt

SEQ ID NO: 5782 - DNA, 1308 bp, Homo sapiens
ggaacttgcctgtcaagacagttctttttgtaaacctaagaacctgagagcagggagattccagctgctaggagttaaataattcctttggcacttagcgtcctatcaaaacagagaagcaaaagaaaacaatgagagcaacaccaccacctcaaacaggtgccctgtgctgggccgtgtcctgagagtgcataggagagacatcgagacatccacaagataatgcccatttcacttgatcttcttcatgtctgggggaaaccaagacacaggaaggttaatgaatgacctgcctgagggtctcagatagtcatgagcagaatcccattcaagcctcaggagtttggctccggagtccaggccttccacggctgctgcacagcacagcttcctgtcagctcagaactctgacctccctgcaggtgctgggtgggggcagaggggacagcgaccctggtcctgcctgtagagcgtactggaggctgaatcataagtcagtgttggcagctccagactgaggaagcgccggccgggccatcttcacccgctggtattccctgggtgcgcagcagtagcagagggcaggaatgcaggaagtcgctttaccccaggctcttgagaaatacagtcatatttaacccctgaaaccactgcctgaggttctctgtcacctcattttgctgattaggcaatcggggcacagagacaatgagccacttacccgaggacacacagctcccaagtgccagggcatggccccaagggcaggaagtcagcctggtaacaccctctcaggtgctttgagaaaagtctaggggctggtgtgcttgtcaccatgtggctgggctaagagatgaggatctgggcttcctggtcaggggaacgtcatgaggagcctgtgccagtgctgtgtgcttggcgtgtgcgtgtcggcagctctgtggtggttcttcagggcaccctgatgggagtccctcgccttctctccacagcgccttgggtgtctcctcctggagcgaggcattgaacctcaggtgatgtcagccctggttcgtctcggcctcagaggagcccggctatttttcctgaacagccccccttcctccctgggagactttcggggtggccagcgtgcttgcttcccaggcaggctgaggtctacctccccgcaggcgtctggcctcaggcctgcagtggatgattgtgggctgtgtggcctttgcctttaggggtcgtcccttcctccataaaataatcctaacagttgtgttttgcgtctattgtggaataaagatgagtattacacag

SEQ ID NO: 5783 - DNA, 755 bp, Homo sapiens
ggaggaagactctgtctcaacaacaaacaaacaaacaacaagtgatattggaataactagtcgtgcatatgtttttttaaaaaagagagaaccttgaccacctctaccttacaacttaacaaaagttatttcaaaatggatcatagacctaaatccaacctcaaaattaaaatacttcccgaaggaaacatagcagaaaatctttgtgagcttagattaggaaaaaagtttcttagatatagcttctatatccatgaagcataaacaaaaacatatgctaaactagatttcataaaaattaaaaacatctgattttcaaaagacactcttatgaaaatggaaaaacaaaccacaaaccgggaaaaaatgtttgcaaggcacataaatgataaaggacttttattgagaatgtaaagaatcctcaaaagtcagtagtaagaaaataactaaatttaaaatgaccaaaaagtccaacacagtggcttatggctgtaatcccagcactttgggaggccaaagcaggaggatcgcgtgagtccagaagttcaagaccagcccgggcaacacagtaagaccttgtctctacaaaatatatatagctgggtatggtggtgtgttcctgtggtcccagctactcaggaggctgaagtaggaggatcacttgagcctgtgaggttgaggctgcagcaaactgtgattgtgccactgcactctagcctcagcaaaaaataaataaataaaaataattttaaatt

SEQ ID NO: 5784 - DNA, 401 bp, Homo sapiens
tgctgtgtccactcccttggctcccacccttgccccagctcggcgcctccgattcctctttctgcttagcattggcgccatgcagctgaatgtggcttgaggacaccggtgctgctcaggcaaccgaagaaggaccctgatgtttcccagtgacccctgcagcctcccctcggcatgccacagtcccaacctcaaagccctgatggtttctactttgttttatttcatttatttattttttaaaatttattattttttttgagatgagagtcttcctctgttgcctaggctggagtgcagtggtgcagtctcgactcactgcaacctcctgctcctaagttcaagagattctcctgtctctgcctcctgagtagctgggattacaagcatgtgccaccatc

SEQ ID NO: 5785 - DNA, 1036 bp, Homo sapiens
ttatgggaacatttgggaaatgttttccagatgttttattttttcccttttatagtttgttgacatttaattttacttaaagatgacaattttaatcggaaatgttagaggtacaacatagtgaggttctagctagctttatacttttgaaaaatatttttgtttctactgctttttacaagtactagtcctctcagtgatactggtggtgttcagtatgaatccatagaaagaaaacaaaatttgttgtttaaaaaaagcagagtaatgaatgaatttcagttttgaaaacaacataatttgaaaacactgttatactaacatggcaaggtgttaattaaatataagagtaaggtagtaagttcttttagagcacctgtttaaatttactccagtaatcatcttaaggattgatagtcaccatcacttattggcttaaaagttatatttcatggaatattatcagtgttaaatccaagctttgtggagctttaagtgatggtggtgaaaaagttggtgtttatgagagagtggtggggtgtctagtcattagtgaagttaaacatcaacctgttttagaaagaattttttagtcttgcctaaagtaaaccagaagtgtctagtgtttaaatctttatttagaatgcttctcttaaaagtattttttgtttgggtagtattaaataatcagtaaataatctatttcagtagtaaataatgaattaagatgatgatgaatgaggattaacacactggtctggagactggggttttatttcagtgggttagctgtgtgtgacatgttgggcaattactcagctgttttaacagcttccagatatgcagtatggtgcctgtactactcaaaagttgattttggtttaattcatctttaaggtacctcccagctctaaaactatgattctaggctgtgtaatggggttattcctactttattctctttccttttttaagggttcattttatacttaataagcatccatttcttgggtcacctacagtctttggtcgatcc

SEQ ID NO: 5786 - DNA, 1166 bp, Homo sapiens
gggttccccagctgaaacttgtccacgggtaccatgaagaggaaattgtgtttaaatgttattacaagtcctccaagcttctatgcatgtgaagaaatttgaattctcagggggaaactgaaaagctctggaaatcacgtactgctcaattcaattcagaaggtgtgagttcctaaggagcattttcacttcctttcaaacttaaaaaattgtggtccaaggaatgacatgggattctgactttttatgacccatgctaactgatttggtgacttctgccagtgcaggaggctcggattttcccctgaaagagcgccctgctcatctcagaaaggttcaggctgtcgggtccattccgcaaggactcgcttcatgtatttcctttacaagtcagaaatggaaaaagaggaaattaccatcccacatcttttcttgatgtgtatgaatgcgtctgcctccaactctgagggtttcttctccaatcaggaaaaagttgacatttgccaccaagtcagtacgcttctaagctttcattttatttcatcaggactgactgagcgtcagcattctggccgagtcctgcagttttacccactgtgcaggtcagcgttttcttcaaggactctggccctggcttgctggcatcctcagagtgtctggatgttacccaggggcttcctctcacctcaccttcattcttgttccttgttcttagatggatgggaggttcagttgttggaaactaccagttagactaagaaagctggacttctttcatactccttaaggcaagtagggtataagtaagtggcctgttggctgatctcaaacatgagagagcattaggttcattaataatattctgactttttcttatctaagccagtttactgattaagaaatcatctggtgaaattaatctcaaatatttttaaatgctcaaagaacatattgcttcagcttcattaaatacttgtctaaacacctggaaaaaatttccacctctgtttcacaatactttgtgtagtgaaacctgatggagtgatagtgtgttagttattatggaaatattgtggacaattcacaagcagagtgtttgttccataaaattaaacctgaaatatgtttgcttgctcttaagttagaagtattgacaagcaggaaac

SEQ ID NO: 5787 - DNA, 433 bp, Homo sapiens
taggttcgaagcctcctccaataacctccctttgtccaagaaaatgcttgccaattccgagcattttttgtctccagaatatctgtcatatcaaccccatgtcgatctattcatattcctccttgctcagcaacagtaggccttcaggatttttctttgatttattgcagtggcctctgaagggtcttcctccttcctattgagcacgttcctatccattcccaatatttcagttagaggaatactaataatactaatgcaaagctttgatcagaacactcttctacctacaaaatccttcaggacttccaacgtagacatgactacctaactcatccttctcttcttctcctagaaagcttcaagaaatagtaaagaaaaaagaaagaaagaaaaacaatcagactgcatgttaggtgaagctaggaactat

SEQ ID NO: 5788 - DNA, 521 bp, Homo sapiens
gagatggagtttcaccatgttggctagggtggtctggaacttctgacctcaagtgacctgcctgcctcggcctcccaaagtgctgggattataggcatgagccatcatgcctggctggtgtactgttttaataaaaagcagaaacaatgctaagtgtgaatcttaaatacttaatattgagtaaaagggaccagatgcaccaggatacagatttttactccaattatgtaagagaaaaaccaggcaaaatcagactttactttaggcatataaaaaatgcataataaggccaagcactgaggtcacaagttctaaacaagcctgaccaacatgcaaaaccccatctttactacaaatacaaaaattatccaggcatggtggcacatggtccatgcctgtaatcccagctacttgggaggttgaggcatgagaatcacttgaatctgggagccagaggttgcagtgagtcaagatcatgccactaaactccaacctgggtgacagagtgagattgcatctcc

SEQ ID NO: 5789 - DNA, 497 bp, Homo sapiens
gttttgggagacacggtgctttttctaaacaatcaatgtctatctacaaagaacttcccttaaaaaccaaactttcctcaacctcatctcctttaatttttctctttccttatactttccacacaacaatcaaatcctctatcttccatgccctacaaccagggttctacccaaaccaggaagctgtattagctgtctcaaaaacttttcttagtccttcagcgttcctggcagtactgtcactatcaacttttctttcctgaacacctagttgtctctgtggcgactgtactttttaggttcttttcctgacagttcactatcaatccttgataatcagttctcttactctcccaaatgtgaacatttctcttctctagcaaaaaaaaaaaaggcatgtggttccctgttttccctctatgcagcttcaactctgacttcactctgtaactgtatcctaaatttccaatacaaaaatcttttttttttctgagatg

SEQ ID NO: 5790 - DNA, 521 bp, Homo sapiens
  misc_feature (373)..(373): n is a, c, g, or t
  misc_feature (391)..(391): n is a, c, g, or t
  misc_feature (459)..(459): n is a, c, g, or t
gttttgggagacacggtgctttttctaaacaatcaatgtctatctacaaagaacttcccttaaaaaccaaactttcctcaacctcatctcctttaatttttctctttccttatactttccacacaacaatcaaatcctctatcttccatgccctacaaccagggttctacccaaaccaggaagctgtattagctgtctcaaaaacttttcttagtccttcagcgttcctggcagtactgtcactatcaacttttctttcctgaacacctagttgtctctgtggcgactgtactttttaggttcttttcctgacagttcactatcaatccttgataatcagttctcttactctcccaaatgtgaacagcacggntgccccagcagtgagggnctccagctcacctgtcaccttgtgtcagaagactgtggactggagggtttcctctgctgttgtacagntaggtctgtttcttcaggaaacctcttctatacctgaaggcaacaggcacttgagtaggagg

SEQ ID NO: 5791 - DNA, 160 bp, Homo sapiens
gttgcatccagatggaatttgctcagtttcagactgggacttatattagaagctcactgacctctgtgcaagctgtgcaagctcctggctgggtctcgggagcctataaggaaaactgaatattcaggctttgcctgatgccatttggaggtcccagcct

SEQ ID NO: 5792 - DNA, 890 bp, Homo sapiens
tgcccaatggccaaaggaaccgccttgtgagaccaaattgctgacctgggtcagtgcatgtgctttatggtgtggtgcatctttggagatcatcgccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttatgatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgcagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggcttcaccgtca

SEQ ID NO: 5793 - DNA, 520 bp, Homo sapiens
ttacagtcaagtcaccttagatttaaagtacggaatacgcgaaaccttcctaactggtaaagcgctcagtaatgcaagctctgggtgcaactcagtggttcttagtatagtcagagttatgcgatcatcagcacaatctactcacaccctcctcgaggtattaaataaatatttcagaatccacaatgcagccaatctcatcaataactttactgaatcctgtagcccagcactcaggggttctctaaaaccctgccccgccttcccctccaattgcggtgcccactgtctcttttaaatagactctgtcctcatcaagcctgttctctgtcccccaaatatgccgtatcattccttaatgcatgcattttttccccagttccctacaatcttataattagtggttacgctaatctatatgtgtgtttaaactcatagaattgtatacaaaaaagtcaactgtactgtgtacacacatttaaaagataaaatgtgttcttttaacgcttaaaaaaaaaaa

SEQ ID NO: 5794 - DNA, 444 bp, Homo sapiens
tgtttattatgtgcagtttaccaaggctcagagagataaccaaattacattaagatgtacatctcatcagcaaagctaggtctcaaacccaggtctctcactccaaaaggagactgtgagctgataaaggtctcgaaaacaaactcctctcctttctagagcatgaccttgagtaagtaacatcaaccctagacacactagttctctccttcccatttctcaagtgagtcataataattcccacctgtcaggatggttgtaaagattaaataagatgctacacataaaccatctttcacagtgcctgctatataccaggccttcagttgattttagttccctctttcccttcttacaaggaaaatgtcagggaatttttcagggttctgggcccacactaccaggggtaaccacaaattaaccatgtgctcagaaaactacagg

SEQ ID NO: 5795 - DNA, 430 bp, Homo sapiens
acattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgct

SEQ ID NO: 5796 - DNA, 217 bp, Homo sapiens
gcaacagtggccttcacaccccccactcccttttccccaccttcccccttttcagcaggagaccccgctgtcttgcacaaagccccaaatgaacagtaaaccaaggcagagctgctcctgaatcgggcgcaaagggtcccagagaccatggctgccctgtccctctgcgtccagcagtcccttggacagtggtgcacgtttctgtggggctccttgc

SEQ ID NO: 5797 - DNA, 222 bp, Homo sapiens
gtgaattggatcgggagacgagggcgccggatgaggcggacttcatgttagctttagatccagaaatttccagtcttctcatctatcgccgaaatcttctttctgaagatttcaagctgacagctacaatgtctctgaaaccaaggaggtctttcctgtgaagcccacttggcttcctcgcgacccgagctcagttgcggaaccggtcgaattgtgtggcgg

SEQ ID NO: 5798 - DNA, 599 bp, Homo sapiens
gtgtgtaagaatgtgtgatatgtgcacacgtttatgcacaaatgagtgtgtacatgtgtgcatataaatgtagttttgagtgagtgtgtgagtgtgtttgtgcgttggggtactcacactgactagtgctccaaatagactttagctttattcatgcttctctctccacctgaagtgttcttctctccttccctatcctgtaaactccttttgatttatcaagattcaactagtatcatctctcaagccatccttgagctctttgggaagagttgatcattcttccctgtgttttcctctgctttactctaattagagtaagctgcaggtggaggcattaaaactgtatgacctctagactcagacgttataggtttgaatcttggctcttcgacttgtagctgagtgatcccagatcagttatctgaccttcggaagccttaattttcttatctataatatggaaataatggcgtcgtgctcataggattgataggtttaaataatacaatgcatgtagagcatttcacatggcacctggtttgtaataagtgctcagactgtatcaattatcatcattactcttacgagtgtatttg

SEQ ID NO: 5799 - DNA, 472 bp, Homo sapiens
gccacatgcagtggctcatgcctataatcccagcactttggaagcctgaggcaggaggattgcttgggcccaggagttcaagaccagtctgggcaacatggcgagaccccgcttctacaaaaaattaaaaaattagttgagcgtgatggtgtgtgcctgtggtcccagctacatgggaggctgcggtgggaggattgcttgagcctgggaagttgaggaaaagaaggatccattgccctttccatcgtgtgaggactcagaaggtgtcatctgtgaaccagagatgcctcaccagacgccgaatctgctggcgccttgatcatggacttccagtctctagaactgagagaaataagtgtctgttgtttataagctacccagtctacagtgtttttttaagagaattaaatagtttattagctacatacaattatggatgatacacaagcctctacctgcacgacaacacata

SEQ ID NO: 5800 - DNA, 3921 bp, Homo sapiens
gccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaagctgggcttctttctcatctctctcccaaatgttgtatctcagtattcttcctattcgagtctccagggggtggctggacctacctggtcatttgaaacaggcccccaagctggagtttttaatctggactctctggcttgctgtgacccctaaggcaatgcttctcttccctggattccttagtgtgggtcacagtactgtgttcttagttgctttagctcttaaaacatacgaagtgttgcctaaactgaaaatatttatcttttatttaaaatcagatttttgtttttagactgtcttagatctggggctattacgaatcacttcttcttcagtaaactttgactcaacttctcctgctgaaaagaagctcgctccagatgtctgcatgggtcctcggcactcttggctgaggactcaaaggttttaatcaggatcgtctaaaaatgtacctcggtgaggaggcacagattttgcctcctgttgaccagcctggtttcataccgaaaagacattgaaggactgcagaaatgtatgggtgcaccgggccgagggaagggtggctgagtgagaggcgtataaaatggggctgtgtgcatgcaggcccatgtttcagcctcagcccacgccaggtgaaaggatcagcaatgctctgttgccatcgtgctgggacgacaccagctctattgccaccgatgagtagctgaggtcagtgtgcacagagtttgaaattaagttaatagactttacagcagctggtctgacactacgcgcagtgctcggttgtttacaatcagtggggaaaagggcagaaccagtgcccggccccacactgcctctgtggcctggactttgaaaggaacccactgaacactaattatgagccctgtctttcccccagaatgcctccctgggtttcacaaacagccttgaggttggccctcctcaaggtcagccttcagatttgggagcaaacttcagagaaggcagaggaagatacattgccttgctgtgggctgcctcttctttcctcttggtgtgcgaagtatttcagaaggccattgatgaattccccctctttagctgtgtatttgtgcacgtgtgtgtgtacgtgcgtgtgtgtgtgtgttcctgtgtaagtaacagaccagactccttttctcttctgtcccgtcaccaggctcttgcttcactgcagatacagttcactctgaaagctggttgaaggagagcagcaaaaatgtatcaggggttttgcttctgtgtttcgccaaagctcataagggctgtgacccacccatatggccccagttttttctgtctcttctgttccaaagccaggagagctgacttccaggtgaagggatgggaaaagtggactctcattgtagtgactcccaacctacctaataatttgttaacttaggaatatgctatcattgttgacttgttcttccttaggagaaggacgattttcacccaccctttctgttctatggtggactcttaacaggtgctatgtgaccaggaatctagccgggagtagcagaggccctgtcttctgaagtctcaggcttagaagttaccaaagtgggctcagaaactgtcatctcctggttccaagttcgggctctggcagcccagccgctatcttagctgtctttcccagcggtgctaagagtggtctcagtgagaaggtagatgccaactggagggccagacctgtgtcctgcccatgtcctccttggtggacgtttctgtttactcagagctgctagagaccatcctgcccatccgagttctgagattgggactgtgatgttgggacctgaggactggatggtagaatactggggtcccccagctcttagcaggatgcaggctattgcttccacacccctggccgtgagaacgtggtatgtaggagagttggctgtagctttaggatttctggaagccaatttggcatggcctatttgatctctggcttgtgctcctgctacactgacagactgattgcgtggctctttcagaagacccaggaagggcagctccagccagaggaccttcctggctatgcaggtgcacagctcttaggcatcaagcaaagggtcagccagtcagtagtagtgggaggaagcccttcctcctcttatgcaagcagctcgcagccagcccagaatctcttatgcagcccaaagggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttacttttctcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgaaaaaaaaaaa

SEQ ID NO: 5801 - DNA, 645 bp, Homo sapiens
atgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaatacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagatcctgtgaatggatttacagcccatgtagcagaccaaggtcttccacagagagcaggttcctctctgtcttcagcatgtggagtctcaaatggaacagttctgggcagagtgctttgcacagagggtgctcccaataaatgttttatcactgca

SEQ ID NO: 5802 - DNA, 4152 bp, Homo sapiens
atgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaatacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggcgtataaaatggggctgtgtgcatgcaggcccatgtttcagcctcagcccacgccaggtgaaaggatcagcaatgctctgttgccatcgtgctgggacgacaccagctctattgccaccgatgagtagctgaggtcagtgtgcacagagtttgaaattaagttaatagactttacagcagctggtctgacactacgcgcagtgctcggttgtttacaatcagtggggaaaagggcagaaccagtgcccggccccacactgcctctgtggcctggactttgaaaggaacccactgaacactaattatgagccctgtctttcccccagaatgcctccctgggtttcacaaacagccttgaggttggccctcctcaaggtcagccttcagatttgggagcaaacttcagagaaggcagaggaagatacattgccttgctgtgggctgcctcttctttcctcttggtgtgcgaagtatttcagaaggccattgatgaattccccctctttagctgtgtatttgtgcacgtgtgtgtgtacgtgcgtgtgtgtgtgtgttcctgtgtaagtaacagaccagactccttttctcttctgtcccgtcaccaggctcttgcttcactgcagatacagttcactctgaaagctggttgaaggagagcagcaaaaatgtatcaggggttttgcttctgtgtttcgccaaagctcataagggctgtgacccacccatatggccccagttttttctgtctcttctgttccaaagccaggagagctgacttccaggtgaagggatgggaaaagtggactctcattgtagtgactcccaacctacctaataatttgttaacttaggaatatgctatcattgttgacttgttcttccttaggagaaggacgattttcacccaccctttctgttctatggtggactcttaacaggtgctatgtgaccaggaatctagccgggagtagcagaggccctgtcttctgaagtctcaggcttagaagttaccaaagtgggctcagaaactgtcatctcctggttccaagttcgggctctggcagcccagccgctatcttagctgtctttcccagcggtgctaagagtggtctcagtgagaaggtagatgccaactggagggccagacctgtgtcctgcccatgtcctccttggtggacgtttctgtttactcagagctgctagagaccatcctgcccatccgagttctgagattgggactgtgatgttgggacctgaggactggatggtagaatactggggtcccccagctcttagcaggatgcaggctattgcttccacacccctggccgtgagaacgtggtatgtaggagagttggctgtagctttaggatttctggaagccaatttggcatggcctatttgatctctggcttgtgctcctgctacactgacagactgattgcgtggctctttcagaagacccaggaagggcagctccagccagaggaccttcctggctatgcaggtgcacagctcttaggcatcaagcaaagggtcagccagtcagtagtagtgggaggaagcccttcctcctcttatgcaagcagctcgcagccagcccagaatctcttatgcagcccaaagggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttacttttctcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgaaaaaaaaaaa

SEQ ID NO: 5803 - DNA, 1526 bp, Homo sapiens
ttttaataaagtaaaaaaaaaaaaaaaaggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttacttttctcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgaaaaaaaaaaa

SEQ ID NO: 5804 - DNA, 1350 bp, Homo sapiens
aattcgcggccgcgtcgaccgagaagacgacagaagggcaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttacttttctcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgaaaaaaaaaaa

SEQ ID NO: 5805 - DNA, 1014 bp, Homo sapiens
atgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaatacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgagtgtaagttaaaagacaggatacccttctgtttgctgtggttgaaaactggtgacatttagaaaataaaagtaaattttttttgta

SEQ ID NO: 5806 - DNA, 454 bp, Homo sapiens
ccctgctcctggctccggaaccacgcacactggggaaggtaactgatttcctccttcctttcaactgtggcctcccagtgtgaggccttcagatggggaggtgcaacgtgggagacagtgtaaagcgtggaaagagtgctgtttgggtcagttgccttgggctgtggctcagctctgctggtagtaagctgtgtgacctggggctgggtaaccccttttttccttgggttttagttttcttatcaggaaagcatggggcctggcctgaatggtctctagagccattccagctttggcggtctatgaccagtgattgtttttgattcactcatttgttcaacaaatgtatttaagcactatcttataaatggaacaaaacagttctaggtaagaagggaagatttcctgaagtaaattatgtggttcctaccctccagaggcttgtagtctgtgt

SEQ ID NO: 5807 - DNA, 327 bp, Homo sapiens
aacaaatcgcaatgggaccattttgcactcttgctgatgatgtataagtgtgctgagcaggcttggaatgtctcctgtctgtttcggcaggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgtgagtagaagatgataattgccttgcttgtttttccctaaagggcacccagtctgcaggctttcat

SEQ ID NO: 5808 - DNA, 665 bp, Homo sapiens
gacatgagagggccttctggttgccatgtggcctcactcacagggcaagggacattcccagcctgcagggatcctgcagcaggaggacagagcactggcctgagccaggagtcctgggctcgtgtcctgtccacccttacttttaggacttcctagctaggcagtgggctgcagagtcccttctagtcccaagagcataacgtctgatgaaataactttatttaaagagcagatgtgcttctggagaattctggggataaaagagttactttttttctgaggtttttttttttcttggccattaacttttcttttttctgcactttctctcctctctcactactctctcataggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggtacgtggagggaggatggaaacctaggagcactggatatttttaaaaactaatgggtcacagtgtggattctccctcttacttatctcttaaaccagcccacttcactctagcccaccatcccctgccactgccagccctcact

SEQ ID NO: 5809 - DNA, 454 bp, Homo sapiens
gcttagccagaagttgtgctgtgatcaaatagtgccgtctgcctggagtacagcatgggggaagaggtttggctgtgttttgatgtagtcactgcccatagtgttgtagttgcttcattttgatgtgtcatacagctaaagatgctccctttaggtcatttttgttgccgctgcctctgcggcttgttactactgttctgttttggcattgtgccccacttaccatgaggattcccctactgttcaatgtttctgaattttttccctaatcctaagcatgtacatgactgttcctcttgcccctcatgcacgtgccattgtaggtagcagaccaaggtcttccacagagagcaggttcctctctgtcttcagcatgtggagtctcaaatggaacagttctgggcagagtgctttgcacagagggtgctcccaataaatgttttatcactgcata

SEQ ID NO: 5810 - DNA, 413 bp, Homo sapiens
ccctgaaggttggtgtgaattccttcatgagagtgcgaaggcactttcatgggggtcccacagccatcagcccttcctcctgctggatgaactgtgaaatcatcaatccaggctgtgtttcaaattggaaaggatcttaggagacatctcagcttcctttagtttggggaaattgagaccaagagaggcgaagggattggtgcacatatcaggcattgcccaatgctccatcacaaataggaccacactcttgagtgtttgagatagtgtaggactttatccattaaatgaaactagcttctcccagaattaactcagtggattttaaataattttagcttccaatggtgtgtttgctactttttttatgcctggtatgtttagatctgacattctttttatgctgagatata

SEQ ID NO: 5811 - DNA, 1442 bp, Homo sapiens
tggggcctggcattcactgaaacactgctcttgaggtcttggccacacacccacacccagcaccccaactcaccccctgcacccttgcctttctgtctggagttggccccactccaagaggcccccagatcctcccctctgcgtttatcactctggtttctattccttcacccctcagccttctataaaaagccaacagtaatgaccctcaagcaggtacaagttcccaacctggcaccacatttcctggcacaggagcaagaatccctacctcacaccactggcatggagatcaagggatccactcatgggccaaggccgctcccagagcttgaactcaggtcttgaaatcacagcctcctaggatcctgtgagcagggttgaggcaaagacccataggcttcctggcctggcgcgccaggctcagccacctcacatgaagcacagtgggctgagcctgacctccaggcacgcagctcatcagacctgtagggactcggctaccaaaattgaaccaccctccacccttgtccagtgtgaagttaatgacgggcatggctcccgcctggaaaggaaagcaaagaaaaacctctcccatccccagttataaaacggcgggtcagcatccgatgggcttaccgactccgtgtgtgtgtgtgtgcgtgtgcatgtgtgtatgtctgtgtgtgtgcgtgcatgtgtgtgtctgtgcccatgtgcagcatatctggttgtcaagttcatctgaaagtgggtgggtgaataacgtcctgaaatgacaacaactagcagataaaagaggaaatgttttcaagcagaaactctgaaggcctttgccaacagcccctgcgccgggctctgccgggagcctgaggcagctccccaccccagcgaggagcgactgcattttaataagtaattagtgtggagtggatgctgctacaaagactagcacgtctcactgccagcattaaggcagggagtgcaaatgaactcaccgcagcattagcatctcagagtcatcagaccgactggcagaaaggcctcgggtgagcacagagtcttctgcactcagcaaattaatgaacaaatacgaagaggaaatgaacaaacacatgcagcctcggggcctgggtgtggagataaggggtgctggatcaataccccaaggttactgctgtgttctcccctggccagacagagcctgcgggacacattcatcaacgcagatgtaaaatggagaaatcaatgacatggcacgcgacattgccatggcgatgtcgcgtgccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcg

SEQ ID NO: 5812 - DNA, 383 bp, Homo sapiens
tttctttttaaaaaaattactagtcattcctgcaggttggtatcctacaaatcaagggtttactgtatgattattacatatccataagaaaaaaatgacaatttaaaaaattttaatggcaagctctggcatattaattggaaatccttggttcttagtctaaacattgaattgttgtgtaatcaatttctagtcaaataatcaatttctacttcagtttcattaataattatgattaagtcagtagcaaaaaagcatgttatttctcctcgggaagatgtaagacagcttaacttaagggaccctaaatatggtctttgtaatcagtggacttgagtttacaacccaacttcaccacttatttttgtgactttggaaaagtt

SEQ ID NO: 5813 - DNA, 3230 bp, Homo sapiens
accgagggtaatcggaacgaggtttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgtgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaagggcttgatgtctaatcatt

SEQ ID NO: 5814 - DNA, 497 bp, Homo sapiens
gtaccttcttagtactactttacccaggtgagtcctctaatgagaatgttaaatcactagtaacaaaattttgcctttacattgatgaattaattatctcttgtggcttttgacttaaaccacatcctaatctggttgcaggaatacattaggtttatttagtttaagcaacataatcaaattaaccggacatgatcaatttgctgatttaatgactctcattttttccttactgcagaccacctgagtggttatcttcatttggggggccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaagggcttgatgtctaatcatt

SEQ ID NO: 5815 - DNA, 3994 bp, Homo sapiens
accgagggtaatcggaacgaggtttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgtgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggaggtgagtcagacggaacaagaagccctctgcagtcacactctgaacatccaccacccttgccccaaactatgagctgctctgcatcctttatttccccttcctgttccacacagaaatgggctccatttatccatctcaagtctcttcccagcagctctgccctttgagatctcaatctctgtcatcagggtcactctgtcgtcctcctagcaaccctgacctcggtgtgttttgcagtgggacttgctgctattcttgctacgggagctggtggagaagggtctgatgggacggatggagatagaggcctgcctgggcagcctccaccaggcccagtggccaggggtaaggagtctcctgtcttttaggtggagagagaacaggtgttacatatcccatctgtcctgaaaggaagcaagtgatggggccaaactaagtggatttttgtcaagagtcttcagggccaccctgaaattgtcccgatttgagtagttattatatgagggactgtgttagtgggaagacggacgaaaggcaggcagttagttggaaagcagcacagcccattatatgggtttttaaaattagaataacctggattttaacgggaataataatttcaagatgaagtagatgcactcagtagtactcaaaaactggtcaagcctgtgcctccatcagagttcgctccctgccataacttcagcctcccagagtactaacaaacagacaaggtttcatgtccatttcagtgtggagggcagttgagaaaaaataatatagccagccaggttgtggtctttagtgacaaaggatgagccattgagaattattacatgctgccttttccctcatctttctatgtattccaggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaagggcttgatgtctaatcatt

SEQ ID NO: 5816 - DNA, 4159 bp, Homo sapiens
tcctgctgtattttaggtctctctggtgatgcctccctctactcaagctgtctcctttcagccagagactgacaatcgtgccaacttctccagtgaccgagcctttcatacttttaagaaacagagggatgtgttttatgaggtgctgcgagagtgggaagatcaccatgaggagcctggctgggattttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgtgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggaggtgagtcagacggaacaagaagccctctgcagtcacactctgaacatccaccacccttgccccaaactatgagctgctctgcatcctttatttccccttcctgttccacacagaaatgggctccatttatccatctcaagtctcttcccagcagctctgccctttgagatctcaatctctgtcatcagggtcactctgtcgtcctcctagcaaccctgacctcggtgtgttttgcagtgggacttgctgctattcttgctacgggagctggtggagaagggtctgatgggacggatggagatagaggcctgcctgggcagcctccaccaggcccagtggccaggggtaaggagtctcctgtcttttaggtggagagagaacaggtgttacatatcccatctgtcctgaaaggaagcaagtgatggggccaaactaagtggatttttgtcaagagtcttcagggccaccctgaaattgtcccgatttgagtagttattatatgagggactgtgttagtgggaagacggacgaaaggcaggcagttagttggaaagcagcacagcccattatatgggtttttaaaattagaataacctggattttaacgggaataataatttcaagatgaagtagatgcactcagtagtactcaaaaactggtcaagcctgtgcctccatcagagttcgctccctgccataacttcagcctcccagagtactaacaaacagacaaggtttcatgtccatttcagtgtggagggcagttgagaaaaaataatatagccagccaggttgtggtctttagtgacaaaggatgagccattgagaattattacatgctgccttttccctcatctttctatgtattccaggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaagggcttgatgtctaatcatt

SEQ ID NO: 5817 - DNA, 3757 bp, Homo sapiens
accgagggtaatcggaacgaggtttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgtgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggtaaggagtctcctgtcttttaggtggagagagaacaggtgttacatatcccatctgtcctgaaaggaagcaagtgatggggccaaactaagtggatttttgtcaagagtcttcagggccaccctgaaattgtcccgatttgagtagttattatatgagggactgtgttagtgggaagacggacgaaaggcaggcagttagttggaaagcagcacagcccattatatgggtttttaaaattagaataacctggattttaacgggaataataatttcaagatgaagtagatgcactcagtagtactcaaaaactggtcaagcctgtgcctccatcagagttcgctccctgccataacttcagcctcccagagtactaacaaacagacaaggtttcatgtccatttcagtgtggagggcagttgagaaaaaataatatagccagccaggttgtggtctttagtgacaaaggatgagccattgagaattattacatgctgccttttccctcatctttctatgtattccaggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttctttaacaagggcttgatgtctaatcatt

SEQ ID NO: 5818 - DNA, 196 bp, Homo sapiens
gtaagagtgggttaaggatcctggtctcatcgccctaccattttttcccctttttcctcagttgctaaactgagaaggtcagccagagggtgggtgtggggctgaaatggctgacacattttgaagcaaatttctgaccaaattcccataaattttcagcctctttccgattaaccctccaaccatccccaacctt

SEQ ID NO: 5819 - DNA, 401 bp, Homo sapiens
ggatgtgttttatgaggtgctgcgagagtgggaagatcaccatgaggagcctggctgggattttgagaagggcttgggcagcagaatcaggtgggtgctcagaccttgtctttcttgttcctggcaatgagtagctcagtgcttgctcggtggcaggagggaggaggagggaaggttttccccgctcctaccagccattagctgttttctactatcctccgaaatctctttagttattgataactctgcctctattcgaaagggatgtgtctctccagctccttccactcacaggtgtcttatccttgttctgtagtggcaattgcttagaaagtccaaagctcttaactcaggttgcttgaggtttttttggcccaagtcactgcttagacacatccagc

SEQ ID NO: 5820 - DNA, 260 bp, Homo sapiens
ctcgggcgggcgggaggtgcaccagcggcggcggcggcggtaaatcctcccggccgctcacagcactgtggagccgcgtccccagcccggcctcggaccgcggcacccctcctggccctcgcggcttctagcccgcccgcccctcccccgcgcgtcggccctgccgagccggccggccgccttatacccttttttgaggtattttgccttcccgtttttgcacacccataaacgctgtggtaaagtaaaagatgctgaag

SEQ ID NO: 5821 - DNA, 292 bp, Homo sapiens
agtagactgacctgaactgacatcaaattctgtaagtctctatactttagagctggagttgaaggaatattgtggaggtcattaacatagaattttattgatgtgtaatatatttataaggaccatctctgaattaacacaattttctttttcagagtccttataggacagttcttcgagataatctgcactcttgtatgttccataataatgcatccctattttacctaatgttccacttttgctaatattactgagaagcatcaaggcacagtgaaaatattggactggg

SEQ ID NO: 5822 - DNA, 3462 bp, Homo sapiens
ctcgggcgggcgggaggtgcaccagcggcggcggcggcggtaaatcctcccggccgctcacagcactgtggagccgcgtccccagcccggcctcggaccgcggcacccctcctggccctcgcggcttctagcccgcccgcccctcccccgcgcgtcggccctgccgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgttta

SEQ ID NO: 5823 - DNA, 3557 bp, Homo sapiens
ctcgggcgggcgggaggtgcaccagcggcggcggcggcggtaaatcctcccggccgctcacagcactgtggagccgcgtccccagcccggcctcggaccgcggcacccctcctggccctcgcggcttctagcccgcccgcccctcccccgcgcgtcggccctgccgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactatacattttgcagaggcatcagaaaactaaagaatgattgggttattttatttctcaaaattaattgaagcagatacttgtgaagtcattgggagagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgttta

SEQ ID NO: 5824 - DNA, 3546 bp, Homo sapiens
ctcgggcgggcgggaggtgcaccagcggcggcggcggcggtaaatcctcccggccgctcacagcactgtggagccgcgtccccagcccggcctcggaccgcggcacccctcctggccctcgcggcttctagcccgcccgcccctcccccgcgcgtcggccctgccgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaagcttaggcacattattttttgtggggtcaaaacattcttgtgtaaattctcttaaacatttgataaacagcttcacaattca

SEQ ID NO: 5825 - DNA, 3291 bp, Homo sapiens
ctcgggcgggcgggaggtgcaccagcggcggcggcggcggtaaatcctcccggccgctcacagcactgtggagccgcgtccccagcccggcctcggaccgcggcacccctcctggccctcgcggcttctagcccgcccgcccctcccccgcgcgtcggccctgccgagccggccggccggcctggctcccctccccggccccgacgggcgggcggactgccctgaggaggcggggaggggagggctgggccggccggcgggcgggcgacgatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtgccaaacattttgagacctctatgatctgtagaactagtccttataggacagttcttcgagataatgcaataccaacaatatttgatcttaccagtcatttgaacaacccacatagtagacacagaaaacgaataaaagaactgagtgaagatgaaatcaggacactgaaacagaaaaaaattgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgttta

SEQ ID NO: 5826 - DNA, 1403 bp, Homo sapiens
gttaacccccattcagttcccattggtgcaaacaaaacgttccaaaagatttccaaattaaccgtttcgggaaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgatatttggaagaaaaagccgtaaggtgtatgtagaccacttaatcactaaatatctttgcctataggactccattgaatacattagccattgataatctacctgtttaaatggcccctgtttgaactctcaagctttgaagacctacctgttcttccagaagagaacgttgaaagtgccatgtttccttttgcgtgatctctgttgatggcactctggaattgtttcagttaagtcattttagacatagcatttattatcactgtggatctctacttgttgggtgttatgaattctttgaagaaatatattttgaagaggtgtgggaggaaggaatacattttataaaatgttgtagtgaagcccacaattgacctttgactaataggagttttaagtatgttaaaaatctatactggacagttacaagaaattaccggagaaaagcttgtgagctcaccaaacaaggatttcagtgtagattttgtctttcttgaacttaaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgttta

SEQ ID NO: 5827 - DNA, 681 bp, Homo sapiens
gtaattcctgagttctaagatttttaaccctctgtgattctcttgctgtgatttataaaaggcacaaataaggcaaatttgattgaaatgaagcagacttgtttcagtgtaactaatgtaacacctcagatattgggatagacataaacttgattcaaaggtacactatatgttgttatgcagcaatttattttgatatttttttcagatacattttgcagaggcatcagaaaactaaagaatgattgggttattttatttctcaaaattaattgaagcagatacttgtgaagtcattgggaggtgagccaattccggttcaacagtttaatcacaaatatttgaggaatatttttgccttgatttgttaaaagggtaataatgatcaaccaaaataaaaggtttcatatgtttaaaaggcaaactacttttatgttcttgacatgaagtaaaaatatcccaaattattttaaatacatttgccatatgcatttttgcatttttattttagtaataaatatggtctcttaattagataattctaaccagattgtgagaaatttaaaggatagttcattcttacattctttagttagagaatagaacagaaagatgagccaggtttgcttttttaatttctaaatgattcttcaatcttgaataaatgaacgcaaatgtgag

SEQ ID NO: 5828 - DNA, 525 bp, Homo sapiens
gtaaataccctatgaatattgaatgaatgagtttgtggattttaaatatttaaccaaagatgtaatattttttgttgtgtatggtttttcatgagcctgtttgtaaaattaattctttgttttccagttgatgaaacttctgagcaggaacaaaaacataaagaaaccaacaatagcaatgctcagaaccccagcgaagaagagggtgaagggcaagatgaggacattttacctctaacccttgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctc

SEQ ID NO: 5829 - DNA, 377 bp, Homo sapiens
taaagaaacaaatgacaaagtttgaatggaaaagcctgctgttgttccacatctcgttgctgtttacattcctttgtggagcctacatcttcctaagctttttagcaggtatatgttgaacacttctgtttcatggttgagacagaatcagaggccatggatactgacaactgatttgtctgttttttttctctgtctttttccatgactcttatatactgcctcatcttgatttataagcaaaacctggaaaacctacaaaataagtgttgtggtttatctagaaaaatatggaaaatattgctgttatttttggtgaagaaaatcaattttgtatagtttatttcaatctaaataaaatgtgaattttgtttaaa

SEQ ID NO: 5830 - DNA, 620 bp, Homo sapiens
gacggcccattccggaagttggaattccttggaggcacccaagggaccaacagaaagtgttccaaaaggaagtttggggttctggattgccaagcgaacgaaggagagctctcaggtcacatcaaggtcaggaaccagagattgaaccttactaacaaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5831 - DNA, 483 bp, Homo sapiens
ggtgatctagaggatcttttggcggtgcctttcacattcaattagcgaggccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacttattgttaggactactctgggagtcttgtgtctgtggtcgac

SEQ ID NO: 5832 - DNA, 703 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcagactggcatagtgagtatggtatacacacaatcggagattctacagaaggaagtgtacctctttgaacgcattgattctcaaaatcgagagatcatgaaacacctgaaggcaatttgttttcttcgacctacaaaggtactgcataaactgagcttccatctgcccaggcagatgcagaacactctgatctgaaagcattaagaaggcaaaataaatttgtattatcataaaaag

SEQ ID NO: 5833 - DNA, 2961 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5834 - DNA, 2907 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaagagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5835 - DNA, 2981 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgttaatcttttgtttttacagactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5836 - DNA, 2664 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgagatggcagttgagaacagagagaatgtcacggcctccctcttatcccgtctcggccttccctgtgaccaggggcttcagggtagctcttgtgtttgctctaactcactccaggtaaccctgattcctgaactgctggcacacacgccggctgggactgccaatgatgagcccaccccaacccacttgtgattctgtatcaaataaatatgttctttgtgtatttgacagca

SEQ ID NO: 5837 - DNA, 3005 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaaaaaaaaacaggggcgcgccaaggagataccggggggcaaggatg

SEQ ID NO: 5838 - DNA, 1609 bp, Homo sapiens
aaatggcaggtcgaggcctggtctaattcggccgaaggacccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5839 - DNA, 1132 bp, Homo sapiens
atcttgcttaggctattttttttgtgattcttcgataatggcccatttgggcaaaaagccggttagcgggggcaggcctcctagggagaggagggtggatggaattaagggtgttagtcatgttagcttgtttcaggtgcgagatagtagtaggctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5840 - DNA, 1583 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5841 - DNA, 981 bp, Homo sapiens
agaattgcctcttgtctctgataaaggcaagcaactttttcatttggtgaggaaatggagctatatgatcatgcattccagaatcagtcaattcaaaaaggaagtacttttcatgtttatacaaatgtagtagaatcttgttgctacagcttattttttgtttctgtgaagcagcagtcctttttcattggccttttttcctgcagtaaatgctcataagaactgtaccatttacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5842 - DNA, 817 bp, Homo sapiens
ggtgatctagaggatcttttggcggtgcctttcacattcaattagcgaggccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5843 - DNA, 2426 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagcaagaggttccttagagaaggtcttgctttctgaactggacacccgaagcaagggtttcaggtacaattaaggtaaggggc

SEQ ID NO: 5844 - DNA, 2526 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccaggtcagtccaatttgatgagcacctactatgtgtaaggcactgtgccaggcagagcaagagataaaaaggcaagtaatccttcttcatcaacatggaatttagtccaacaaggagctgacatgagaacacaaattaatattatttaagatagatctataaaaagagtcacaagagaagtgtaatgtgcaattcccaagggttcagttaattagtataagggcagcctagtctactagaaagagcaccaaactagaatcagaagatctagattggagtgtttggtataccacttacaggctttgtgacatggagctgttgacttaatctctgagccagtttcattatttgtaaaataggtatattaatactcatctcacagagtggttaggaagactttaaaagataaaacatatattaaaatgtattgtctaagttttttcattattgaagatctgcttttcatcgcaccaacatattaatgcctgctatatgtatatactactgctgtgaggatctgaatacaaagatgaataagataccacattacagtaggggagaaagaaatttaaaccagcaattgtaataccaagcactatgtactatattagaggtatttacaaaggaatatggaaatacagaggaaggacaactgttttccccaaggatgaagcttcttagcacttcttagggaaaataacatca

SEQ ID NO: 5845 - DNA, 1219 bp, Homo sapiens
tttattttttaatttttttttttattagagacagggtcttgctctgttgcccaggttggtctcaaactcctgggctcgagcaatccacccgcctcagccttctaaagtgctagcattacaggcctgagccaccgcgcctgcctgtaatctgcattttagaaaagtaactctggtgccactctggagagtagattggataagaaagaaactatagacaacatacaagctctgagacagtttcaagagtacagataacaggtgctgatgtaacatggtactgagttaatatagtggccttgcccttaaaaattctgggatcctaaatagaaacttcaaacttgaaatgttagtcttaatagatcttacaaatttaattctaaaaaaaaaatgaagaccctggggaagagcacagagggactgtccttgcagtatggatgttgtagtgctcaactgatgcttccattctatacccaaatatcagaccagtacctcctgcctactattcatgatatattttcatctggttagatgtccagagcaagacattctatttttggagatgcttttgttttttccttcaagtaacctcaaactacttatcagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5846 - DNA, 1630 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggtaaacatattggtcctgtaacacatctcgtatgttggccctttttaaatatttgagtctaaaaataaaaaataaggaaaggtctgtctcaaaagaagttttattatgaatacttgaatatgtttatcacataaatgaggaatattgttttcagaggcagcaaataaactagttttgaatttttcagaaggatgtgataggtgataaatgaataaaaagaatacctgttttaaattatattctctctcatgacaacacattggacagcaaagttcttttttatctgagtagaacattgtatctcctattagcagtattttatttttactaattgataagtatgcatagaggtctccagaaatataatgtgtataaccttacaacctttatttgttagatttattattattgctactgttttgtaattattttaattctcccacgttgactgttgttacccaattattaattgaacaatttagtatctctttacacctgtatttcacaaagtttggctatatcatattatatcacttatgaa

SEQ ID NO: 5847 - DNA, 1047 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggtactgcataaactgagcttccatctgcccaggcagatgcagaacactctgatctgaaagcattaagaaggcaaaataaatttgtattatcataaaaag

SEQ ID NO: 5848 - DNA, 800 bp, Homo sapiens
cgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacggtgagtttgcttttgctcagcatttgtgaaggaaccctctcaaccttacaattgctcgtcccattccactgtaggacttagcatttaattaaacatacgaaaatgagggtcggtttgtgtggaattgaaaagttgtttatataaagcttgcccggtgggttttcagtctacatggctccagccactgcctagagactacttctacccggaacaatttattggaatcagaaatccttttctaaatgtccccgccaagaaatcattaatatgtcagagcacttggaaggctttgggatgggcctactgtttccactcaacattgtgtttttaaagtaaagctgttggagctcaagctgaaatgacagattatttgttggccacagaccagaaaacaaaactctttaaggtgatagaaaaaaatatttttggaaacttatggattgttcctgttcaaagagaccatgttttttgtttttaatcttgaagcttcagctgaaaggatagagcgtatttttcattctcgtatgttacctacctgtttggatgttcagtaaatgttttccgtatattactatttaagttatccagctaagtattaa

SEQ ID NO: 5849 - DNA, 2462 bp, Homo sapiens
gggaagacgaatctcgaccactgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcagactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5850 - DNA, 2912 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5851 - DNA, 2968 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattccgctcggatctcacccgcgccacacgcctcatccccgccccgcgcgccttccacactcacatccacttcgctctccctcaccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaa

SEQ ID NO: 5852 - DNA, 2298 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctctaggaaacttttcgtgttgtgcactgtggtgcctcccaggacaatcctcactccaggagtggtgcggttcaggttataaa

SEQ ID NO: 5853 - DNA, 1264 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccaggtatggaaggaaaggtttaatttatcagtcgagagttaattcagcaaataattagacttgtaagagaaaattcaaatattttctctgaatatatgtttttaacaaa

SEQ ID NO: 5854 - DNA, 1208 bp, Homo sapiens
tctctctcttctgctcgcacacaccccggcgctactctgtcttttgcgtttctctttcttctattctgttgattattctccgtttcgcctccttctttgtttagtttcatttttttatatcttctttgtttgtttttttgttatatttttttttttttttttttttttttcttttttttttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaataacgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccaggctcgaaattgggatccagcccagcacaagaaccaacgccagcacaagaa

SEQ ID NO: 5855 - DNA, 310 bp, Homo sapiens
agtaaggacagcttgaagaagctgctggtcccgttttctttattgtaagcattttcaacatttcgaagcttgcccagtgtttgttttggtaattacaacaggggcatgggaaaagaaccatgctattttcttcttttttctttttatttttagtttaagttctggtatacatgtgcagaatgtgcaggtttgttatataggtatacatgtgccatggtggttcgctgcacctatcaacccgtcatctaggttttaagccccacacacattaggtatttaccctatagcaccccctctaccccctctaagc

SEQ ID NO: 5856 - DNA, 1220 bp, Homo sapiens
  misc_feature (617)..(617): n is a, c, g, or t
ttagagaacccacaaagtcaggagatcttccagagcccttagcaaagggccatctgcaaagcctctcttcctccccgggcaggtccattcccccagggcccagagtggggccaccaagaccagagcagacaccaggaattgaccctggtctggaactagtctgtctgttctgatctgccgccctgtgacaatcacctgcctgggaaccctgctcacagatgaccaggcccagtggagagatgataagaataggtagtttgttctgatgcagattcctaggggatctggctgatgctggctgatggctgcttacagcaggagacctcaagtttctcaatctaatgttcttagttctgcatcaaacagatgggtttattttctggatcctgtctattcacggaactcatttaatatggagggcgttatgatgtcctgcctcatctgctactcaagctatatatttgcaggtgaggggagaagaatcataaggtaagctctcagagatacgagggtcaaggagaatataagatcttacattccctaacgcacctcttgctcttttgtgtttttgcatgtgaccttcatgctggttgtcctctggactgtgtgaccttggngccctcagtttcctcatcttattggtccctgtacttctaatagtcagtgggctgacagtccacacccctctgcagggctccagacctggctgtctgactttccagcaggctgtcccctcggtcatgccgcagacttttcacactgtgtccgaagctgagccttgatctgttcctgaacttgctgcccctcttttgtcctctcccatccactccactgtttgtgctagaaagtggggagatattgttggcaccttccctctcactcctacatattagccaaaggttttatagatttcacacctaagcagtgatgtttcagcctgcttccactctcccgtgctcaggataactgccttggttcagtcactttcatgtaacactcctgcctggagtacgcagcagctcctacctggtattctgattcctctccggcactcttcagtggccctctagtgctccctgagtgatcttttttttgtttgtttgtttgtttttgagacagggtctggctctgtcactcaggctggaatgcagtggcatgatcacagctcactgtagcctctaccacctggactcatcatcaataaacactgttatttgcaa

SEQ ID NO: 5857 - DNA, 782 bp, Homo sapiens
gaatgtagttaatgtaaaccatgtaagtttagctacttaaaatacctttgcacacaagttatgtgtctgatggtttaatatacatatatatgtcttattcttgtatattttccaataatatgttgctattctactagagttgggtttcttaacctggagtccagagaatcccaggacagaaggaaaatcagtgaacttgaatgggaaaaaattgtcatctttatttttaccaatctctaagtgaaatttagcatggccttccattttgaatacggataacaaaataatccagacagtacctacagtttttgtcacagtagaacaatagatattttcatatcataattgttgcagatatcttaagctattatttatgctttcaaattattattagtcctggctgctaaatcttattaatgtgttaataaattacagggaaatgtgaggtttttaaaaggaacattttgatgattacgtgtcattgtacattaaaatacttacattttgttttgtacatttataatcgtgattctgagaagtccgcccaagaggcccatgcacatgtgcacacaccgatacctatacacactcacacccccgcaacacaagagtgtagtaaaaaccctgtattagactatcccagagaattctttgtaataattttttcataggtgcttcaaggaaaattagatatatgttacattactagtagttcttaaactgttttcagctgaagttgactggttaaaattgtctatacttcatttatgtatatttatgtt

SEQ ID NO: 5858 - DNA, 423 bp, Homo sapiens
ctttggacacatgcccaccactaggatagaagagtaggccaccataattgacaacttcatcaggactgtgcggaaggggagaaatgggtccctaaggaagagatgatgggcagataaatgaaatgcacccactatatcccaccctttattgcatccacctatacttttcttgacaaacatacaatttcaaaaatgtgcctgcctgacaatgcaataatcatagacccaacaaaaaccacattcacctatttcccaaggggagataaaacagaattacatccagttgctttattgagccctcagtccagggtcccttggtgatgggcaattcttgctcaggtctggatatgacttcttaagattttgccatctataggtaaaagataaacttagctaccccatacttgccctataaccaatgtg

SEQ ID NO: 5859 - DNA, 654 bp, Homo sapiens
gattacagttttttttttgttgcaaacgatttttatgggctgctgaagtttaaggagtctggcattttaaattgttcttcactgtctgagaagtaaaaatatgtcttaaaaaatcattgatgttatagtaaaggaaagctccctcccttccctaagttagtgcctttcagaatgtgagcatttgtcaagtggaattctgtctgatcctttttcattttctgagctattataagtgctttcttttcctttaactatcataaatggtttttcttcccttaactaagtaaagatttctggaagaatgttttgacccagattgaaaccagcttctgtccctatctactagtcattcatttcttgatttctcgtggcatttcctaaacataggataagtttctaatggtgaagaaagtgaaacagaaaggaaggaaagaagcaaaagctgggttgggtcaccatattgagcgaaggatatgcttgtggggaatcctacactgtgatattggagtaaacagttacattatggggtgagaccaggtgagatggcttatgcctgtgatcccagcactttgagaagctgaggtgggaggattgctttaggccaggagttcaagaccaggctgggcaacaaaaatgagaccctgtctgtacaaa

SEQ ID NO: 5860 - DNA, 261 bp, Homo sapiens
ctctcacctgcctgttttctgtatctaaaagaatctttatgacttcggcttaaactcccactggatgcctgataagctgctatttcacccatgtgatagtatcttctggtagttagcagtgcctccttgcagttgttcagaagattgtagtggttaacagccttaaagttctcaaagaagaaacatctttttccctttagaacatgaatgggcctgacccacaagttcccctaaatcattaaactatcttaagttaaacag

SEQ ID NO: 5861 - DNA, 2319 bp, Homo sapiens
  misc_feature (1100)..(1100): n is a, c, g, or t
  misc_feature (1164)..(1164): n is a, c, g, or t
  misc_feature (1328)..(1328): n is a, c, g, or t
  misc_feature (1531)..(1531): n is a, c, g, or t
tgagacagggtcttactctgttaactcagtctggagtaaaggatgcaatcacgactcactgtagcctggacctcctgggttcaagtgatccttccacctcagccaactgagtagctggcctgcaggcacaagtcaccatgcctacctaagtttttgtagagacagggttttgccattttgcccaggctggtcttgaactcccggggtcaagtgatctgcccacctcagcctcccaaagtgcttggattactggcgtgagccactgtgcctggcctgaaaccactgatgttaaggcaaaagcttgcgtgcatctaattcattttttaatagtttgtaattaaggatgtccagaggaggtgatgtttgccaggtctaccaccatatattattctataaattctacccagtttctcataatactacatctgttcctacccctaataagagtgatatgagggtaagaaaggaaaggcagtcttctgcttttaattacctttagttctgtatgccctgcttcacgctgcatacttcagagatgttaattttaaaagggaaacaagttatgtgtggtgtctgtcttgtttactagcctgaactgaagatggggactgtcttggttgttaatcatcagcatgttatgatttttcatagtgtctagtttttactgtgagggatggttaagggaattggacatggttaacctgaaaaaaattacttggagaactcaatgagtgtcagataaataaaaggctgtgagtggaaccatcagtggaaccatcagaatattctgttttttaagaccttttgttttgcaaaagcagctttttcttaccctaacaaagtagtgccagatttgtgcatttgccaaaaccagttttaaaaccagacaaaatatatgttgccattattttcaggcatagagcaacaagcaacactggattgtgatccctgagagaagaaaaacacaagatgttaaatcccacagatggtcattgtgggattctacctgggggtatctcccagcattaccgtgggagttgagccccaggagagtcagagagtggcaactctgatgcaacagaggttagggttactaaaanagctggaatttataagatagagttcaagattgggaagagaggcagaaatctgcatgagacttgncaagggtactgggatgtgcatgtccaggataaggatctgcaaagtgttagcaaacgattacttcctctaggacttaagagttgaacagtgacaccagaagttatacagtacttagaatccttggaattgcagcctgagtggagcaatctcattgaacactttcntatttagttactactcaagaaatgcgacaccttaggaatcagtagtataccctaaacaaggtttggcaagtgttttcttaaagggctatgacttaggcttgtgagctaggatgtttgtggcttctccaaattcatatattgaaacctaatccccaacgtgatggtatttggaggtggggcctttgggtgatgatattagagtnttagtgctctcataaaagagaccccagagagttcccttgcccctactgacatgtgaggccacagtgaaaagctgtaaaccacaaagcaggccttcacaagacaccatatatgctcatgccttaaacttggacttcccagcctccagaaccatgagaaataaatctgtgtgactgattgataaacacccagtcttctaaatactccatactagtctctggtattttgttataccatcctgaatggactaagacacatagggtctatgttacaactactcagctctgctattatagcacaaaagaagccagataatatattaatattaaacaaatgggcatggctatatccaataaagcttcatttacaaaaatagccagcctatggaccacatttgactaagttcaaacagaaataatcctctttaacaagaaataaaacaataccatttaaaggaagataacataagccagatgccttacaaggtattattcacaatgcctaccattcaattaaaaaattactagccatacaaagaggcaggaaaatctgacccataatcaagggaaaaaaaaaaaaggacccagcttttcttaatagaatttattaatagaccttaaaagtagctatttaagtatacccaagaaaataagggaaaaactagtgaacaaaaaaagattctcagagaaatgggaattggtaaaataaaaatgggaaattcagtacctggaattgtacaagaggtgaattgaaaatttcattgtgtggtcaacggatggggtaaaagata

SEQ ID NO: 5862 - DNA, 477 bp, Homo sapiens
gctattttaatggcttcaaatgatagaggtttatttaactcaagcaacagaaagtttagaggtagcagtagagaaccagaatggtacttcaacaatgtctttgagaacccaggctccaccttcatgctccttcatgctcagcctgtgaattctgtcttcaaggttgtaagatgcctgtgacatttctaggcattacatctgcattatgggaagagaggaggcaaaaggccaaaagccaaagaacatgccaactgagactaactctgtggaattgagggtactttttaattttaggcatcacaattttctagtttccaaatgttccacaacgatatgtattaatgttattttaaaaagaaggctctgctaaatggattgcaacaaagcaaaattattctctgattctgaacttcaagccctgtagaggtcctgttgggctgaataattggagaaccctttctatgcctataggggcag

SEQ ID NO: 5863 - DNA, 663 bp, Homo sapiens
  misc_feature (27)..(27): n is a, c, g, or t
  misc_feature (29)..(29): n is a, c, g, or t
atatatgttttcttcagattgatcaananaatatctcctagtgagaacgcctttcactttggggaaaaaaaaaatcacctaacaattagtatttgctttccatagttaatgcttgaggagtactcttttctccttttcttctttgcctatcccctttcataccaccacctccagtttatatagtgagaatttatttttctaggcacccatctaattttttgtatttttagcagagacagggtttcaccgtgttagccaggatggtcttgctctcctgacctcacgatctgcccaccttggcctcccagaatgctgggattacaggcgtgagccactgcgccctgtcaggaagagtaatttttaagtaaattagagtgaaatttccatgaagtattaatgaggtaagtttaagcaattattttaagctaactttcttttgttgagagaaagaaaatgtcagcgtttttctgccagatgttgagaaattaaagctttttagatgaagatagtaaatcatttttattggccaaagattacttttttaaattgctctcagttccttgattttaaaagataatgctgtttagctggcctgactgcataaagctcacttactagaaaaatattcgaagtatttggataggagaatcctgttgctccttt

SEQ ID NO: 5864 - DNA, 472 bp, Homo sapiens
tcaattaccagtggcaactgtggcccaaaaacattaaatggaatattcccaaaataaataactcggaaattttaaactgtacactgttctcactaatgtgatgaaatttcacattgttccacccaggacataaatcatccctttaatacggtgtagcccacacagaataacctacccctctctcagtcacctagtagtcatctcagttagcgttgttagagtatcatcgtgtttgtgttcaagtatctccctattttacttaattatggccccaaagcacaaaagtagtgaggcttgcaacttggatatctcagagaagctgtaagctagacacaatagcatgtacctgtagtctcaggtagtctggaggctgaggtgggaggaccactttttgacgctgcagtgtgctaagatcttacctgtgaataaccactgcactcagcctgggtgacatagcaaaaccccctaacaa

SEQ ID NO: 5865 - DNA, 356 bp, Homo sapiens
ggattttaagattctttcagtctgagagcacattttaaatttcatagcacatatgtcattattggtgcaataactggtgtttgataccacatattatattgaagcaacagaaaatttttaaaaatctaaaaatcagcaagctagccaaagaactgtatgcttaaaaatggtaaaaatggtaaaagttacattatatatattttactacaattaaaaaatcagcaagctggtatcttgatactttcaattaggtgggaaatagatattttttattttcttctttttacatgttatttgccaggagattttttttaatttttttaactttaaaaaaagtcctttttcctccttctccc

SEQ ID NO: 5866 - DNA, 1035 bp, Homo sapiens
taacaactgagccatatggacaaattaatttttaattcttaccagtttgtatcaggagagcaaagtaagaggccatttaaataaatggagtagttctgaagaagaaagtgggagaataaagtaaaatcacttaaaaaaaggaatcagtgagggcaatgtgatacgtcatataaacaaaagtgccttctcttgggagaatctgtatttgttgagaagatacagtatgtgaatttacacatataaatttattaaaataatttataccaatacaaatttgttcaattatataaaccaatgaaaacatccagaatctcaaacattctagatctgaataatgctttaacatgagggtaagcctcattcaaagcaacttccataacttagtagtaaattacattgtcctaggactttaaaaaaagccctcagatcattgtgtagggccacatgagcatattaaacatggttctaagttttctcattttgggaatatactgtgaaatacagcaaatcaaaataaactctgaaataaagtttattgatattcaataaactttaaaaatcagatttttaaaaagcatttggggcacaaaagcagaaatctgtaaaattcaactggagtttccacacaagaagccagagagtcactagaaatagtccaacaaactaaaatcttaattggatattacaaacctgaaatgagttctaagatagctcttttaaggtctgtcaaaaccagttctctctctactagatcaggtttgggatttgcatcattatttaaaattaaccctataataacatgctgttgtgattagtaattttatccagggggttttaattttgcattcttggctcttcacttttgtttatttttgttttgtggttttttttcagaaagttttcacagaagtctgttagacctcagctctaaagacattggttacacttcaccacagtaaaaagtgcaaaagagtgatgggggagggggcaggcattggatggggttagcttcagctaagaactattagacagtat

SEQ ID NO: 5867 - DNA, 370 bp, Homo sapiens
cttggggtcggcaccgattagctctgatcatgtccatccttgaagatggggagtggggacagtctctcctgaacctcgtcgactgagtttggtggagaggttatttcccaaaggtaaccagaggaagggagaatgcattgttgctgggcagataacaccaccactgcaaggctatgaatgataatcccccaaagcagtgaagtaccaggggttgttgggattcgttctgtcaaaatatcaaaatatgggaaggggcctgggacagtggctcatgcctgtaatcccagcactttgggaggctaaggcaggaggatcgaaaaggcaggaattcaagatcagcctgggcaacatggtgaaactctgtctctac

SEQ ID NO: 5868 - DNA, 619 bp, Homo sapiens
tcgcattacatagcaagaagccagccaaggccatggctgtgactggtgacccctcagctgtgaggcagtccaaagtaaaggtggcactgcatcttcagaagccagcctagtgcggaggggaggtgtttgaaaagcccaaagggcagggcagagggcatggccacttggtccaggcgtaaaatttcttttcccttgttgaaaagtgcaagtggttccaggagctctgtgactttattttctgagcaggcccctctgagaaatcatgtggtccctggtccactcacgcctaggccaagcttgtggcctgattcggggccccatcgttctggggcctacttactcctctccagggctccctagctcccctcctacatccctacaccctccttcccatccagtctttccagaagtgtggtccctcccattccctagggtctgtgggatgctgctgccctaacaagtccctgccagtgcatctacaaaatgagtttcagccagagtttcagtttgacttaagtcaattaagcaacatctcaagggaggtgacaaaaatttcaaagtgtgtttagtgacctttcatttattaaaaacaaataaataaacaaacagatgccaatga

SEQ ID NO: 5869 - DNA, 874 bp, Homo sapiens
aatcagtcccattgcacgggaacacggggttttgaaacaaacagcagcctgtttttatttaaagtcgtgatcccttgcttatcgtagatttttttcataatttgattttggaaaatattgcacacaaatactactcgatccctgagtttgtgggcacttccttacattttgcacccatgaaaatgcctcctccgcctccaggtcaggctccctggaatggggtgtttagtgtcatttccagagacaagctggcagttggctcttgtgtcagagagaagcccacagtcacagtgacaccagcccgcactgtggaagggcttgctatgtgcagtgccctgagccaagtgttccacagacattatctcatttgaaccccatagcagccctggaaggaggcattgggtggggaaccaagttgtcctggggagtcagtgccaagatgtgagccccggacgcggcctcgtcactcacagccccgtgctcctcagctcccacccactgccgcttgacagtcgttttaatcactacctgggctgtggcgaacaatgccaggctctgatagatcctgctgtctcatttctcaacctagtttcccttaactaatatttcatggctatcgttaatgtgcgtttttcatcgagtaatttccacagcccgaacttgtaacacatcccaatgacaaacgtccccagttcggaagcccccgtcagtggcaatgtcacccttgctgctgcctcgacaccttccgacagcccattcagttttatgatcgccctgtcccagtgatcactactgaacctttaagaatccagatgcatttcaagtttaattgaataaaattctttgtataataaattccgcatgaatgctacat

SEQ ID NO: 5870 - DNA, 908 bp, Homo sapiens
  misc_feature (888)..(888): n is a, c, g, or t
  misc_feature (892)..(892): n is a, c, g, or t
  misc_feature (897)..(897): n is a, c, g, or t
aatcagtcccattgcacgggaacacggggttttgaaacaaacagcagcctgtttttatttaaagtcgtgatcccttgcttatcgtagatttttttcataatttgattttggaaaatattgcacacaaatactactcgatccctgagtttgtgggcacttccttacattttgcacccatgaaaatgcctcctccgcctccaggtcaggctccctggaatggggtgtttagtgtcatttccagagacaagctggcagttggctcttgtgtcagagagaagcccacagtcacagtgacaccagcccgcactgtggaagggcttgctatgtgcagtgccctgagccaagtgttccacagacattatctcatttgaaccccatagcagccctggaaggaggcattgggtggggaaccaagttgtcctggggagtcagtgccaagatgtgagccccggacgcggcctcgtcactcacagccccgtgctcctcagctcccacccactgccgcttgacagtcgttttaatcactacctgggctgtggcgaacaatgccaggctctgatagatcctgctgtctcatttctcaacctagtttcccttaactaatatttcatggctatcgttaatgtgcgtttttcatcgagtaatttccacagcccgaacttgtaacacatcccaatgacaaacgtccccagttcggaagcccccgtcagtggcaatgtcacccttgctgctgcctcgacaccttccgacagcccattcagttttatgatcgccctgtcccagtgatcactactgaacctttaagaatccagatgcatttcaagtttaattgaataaaattctttgtataatagaaacccccttggccaaccccccaaaaaaagggcncccngcttntagaggagcga

SEQ ID NO: 5871 - DNA, 408 bp, Homo sapiens
aaacctataactgagtggggctttagagatcctaaaattcagtgcttttacttcatacgtgagaaaaataagctttctgcccaagtttacaaggtacacatagggaaatgggaatgggaactcaagtcccccaataccagtgtattgttcttacccaaacagataatttaagattcacttattgtatatttttcggtcatctctaaaacccactttcttctctgaagggcatgctctaaagtttcttcttcacctatctcccctcagggcacctaatcttagaatgtaagagaaactctgaccaaatttgtcttcatgttgacctcaggcactttagtcattgttgaaacttcttttttgttgtagttaagagaagtaacaagtaagtctttatttccttgtttagaa

SEQ ID NO: 5872 - DNA, 418 bp, Homo sapiens
ttttgagacagggtcttgctttgttgcccaggccagagtgcagtgtgtaatcttggctcactgcagcctcgacctcttgggttcaagctatcctcctacctcagcctcctgagtagctgggactacaggtacatgccatcacaccagctaatttttttatttgtagagatggggtcaccctacattgcccaggctggtcttgaactctggggctcaagccatcctcccaccttggcctcccaaagtgttggaattacaggcgtgacgactgcactgggctggtgaaggtatttttcaaaagaagaaaaaacattatgggaaagatggtatcatatgaccttgatgtgatttcaggttgtattttcactcactgaattgtgatataaaattgccatgctagttaaaaaatacgtcgacg

SEQ ID NO: 5873 - DNA, 489 bp, Homo sapiens
atgtaaagtttaaacagacacacgtacatacacacatacttactgaacatatttaatattaaagacaaattaaatctactcgctgagatgacaaggtccctggagaaggaagatataggttgactggaatgtgtggggacctttcagcagctccaagtaggacacacagccaggtcctgaatcaagctttagctccgggacaaagagaaagaaaagctgaaaagacctgcatgttgaacagatcatagtttatatgttcttgggagttatttccattatcatttttaaaaattctaaatttttagcagatttgtgctctattctcatctgcatttatcatgtcaccaacaatgcatttgttttataaaaaccctaacttccaaaagactgtaccaaaggctctattggctttaaaacaaggctttagaaccccaacttcagggtgctctaaaatgaaaactaagtagacaatctactcaactaagagtt

SEQ ID NO: 5874 - DNA, 246 bp, Homo sapiens
taaagcacctctctagtcttgtcaccctagctcaagaacattcagtggccccttattccctaataaggttgaataaaagtccacatatgaagccctttctactttcccagcccatttctcctgtcctagagcttcgactggcattcagtaaggcatcatgggagggcgtctacaggttttacaacttctctgtgctgggttttgtttgttttctcatatgaggggagatttccaaaaaggttatgg

SEQ ID NO: 5875 - DNA, 801 bp, Homo sapiens
agtcgttgaggaaggggctgccagtgaaaaagccaagatggagtctgtctggctttcttagctaagggagagtcaattcaggtggaaacaaggctaggtgattaaaggaaagggagagtctaagaacagggttagtaaaaaacaaggttgggcattacattataaaaagatacaaacatgcctgtatctgattatgtctgaccttgtacatctcatgacatccgcagtcaatgaacatgtctattttagtctctgaataggcctggaaaggaaaggtatacacaaatacttgataagtggaaaaaataaatgtttgcaatttgggtacataccaataccttccttctgtttattaattgtttaagttttgcttttgttgtatgcaactaaatcatgtttatggtatgcctgtgttctgttttttgcaattatttgacataaatacactggttttgtttttattttgtttgttttagtctacctttcctcagataatgagagcactatctaaacatgcaatctttcaggagacaaagttgtgtattatccatgtctgcagcctttgaacttcagagagatggttactttctggcatctgatagctctctccattgtgattctactgaaataaatcacttctgtctttaatcatgattctgtatctgaaccattggagtctacaacaaatagtaatttccacatgtgttgttttcaaggattttctttgctctgccccacttcagcaagtactttgttatttatggaccatattttctaaaatataaagccatataactttaa

SEQ ID NO: 5876 - DNA, 259 bp, Homo sapiens
caaacagtttagattttttgacctgacctggaaatggaagtgtttggatttatgtgaaattctgaaatgtatagtgtgagaatggaaggatatttggggaatttttctgaataatttcttcagttcaaaaattatcttacaattagattaggtaccataatttaattagatcaaaacaattcacctctctacagttcattttgctacttcaacaacattcagatatttctgcaaaatacattttgtgagaataatacaa

SEQ ID NO: 5877 - DNA, 444 bp, Homo sapiens
gccagaatacaaggctccatgagcactgaatggcagttatgagcaggcctgcagccctcacaaaatgttccaaacttgagtccccagcatgaggggatcaagaagaggtggggcagcccatttgctggctgtgtgtaaagggaggattagcaatggggaccctctagaggccacgcagggtcattgtaggagcttaagggttgggctcccagacccacattcccatcccagatctgccacttagggggtgggtgatcttggccaaatgattttgctgctctaggcccccacttcaggttttttaacacgattgccattgtcttcctacctctgtccctgacacatacatgggatcccacaaaggcgtggctagtgccctgcacacaagtgacagccctgcagcattcactctggccctgacagtgagaacaccaatggcttaga

SEQ ID NO: 5878 - DNA, 1328 bp, Homo sapiens
aaattcggcaagaggaaacgcccacttgaatcagtgcattaacaggtccctgtttcttttgtggactgatccgaggacatcattcaatatccaaagagctgcagaatgttatccttgaattgcgtccacaagattcctgtagataactccaaggatttttttttttaagcaaactagtctttttatgtccgatggtgattgtatgttcaatgaaaaccaaatgtattaaaaggtcagcaatctagtccattagataaaatcttttaattttcttaggatcaaaataatatatttttgacagtaactgtgcactttactccgacttttttttttaatccctcatttcccgacccctgtactctgcgctggttttgcccacagctgcttgcgaatggcaggctttttcctccattcctttgcggaacatagaagagtttgtctcagttctcttagaattgatgttactaactgaagtcaaagccaaaagcatgaataattcaggaacgagcactttccttgccccaccccactgtgctcacccaatgcccaaaagcttcttcatttttaaacgggtgtgtacgttttgctactaggctatgtggtggagactggaggggaccaggaactagatggactgttacattccgaaatttatatcaagtacaccatgctttattgagtgttatcacacctgtattgaaaatagcattaatatttaaaatcttttttaataaaagaagtttccgaacaaacagttaaacataatattgcctcatttgccttggagctagctcatctggtacctctgaaatattttgctgtgacactgctaccaggactgttgtgatcttcccccaaagtactcagcaccattgtcgcatgtccagcgtatttttaagcttaaaatgtagggtagtatttaacatttgggaatttctctttcaaatagaatgaaacgttaagtaaatagtaatatgcctatgatacttctcatttacctgcaagtattaatttgcagagcaccaggcttaatattctcttcccatcctcttggctatcactgattataagttaatggtcttgatccatggctgtgggttcagtactattgtaggagcttggtacacatgatctcagtgaatcctcacagcaactctattgaagtaggatcattcttaccgctgttttgcagagaaagacactgaggtcagaaagatggaattgttgtccagggttacacagctggtaaatggtggatccaggatttacacagagtttggaagattaggtagacctgtcggcagatgctgagttgaaatgggcatttc

SEQ ID NO: 5879 - DNA, 440 bp, Homo sapiens
tctccattaccttgggtactgggtaatttatatactgagatagcgtgttacttcaaggggaaaacaggttctggtgttctacaatactgtttccagtcctcggagaatgcactgtaaatgttacatttatcaaatgctaagtgacatttagcaaataataaagctaatacctcttagcttaactaaggaggggtggacagaatactgtttatatctcacaaacttagttccatatcagataatatctaacttaaccattgaacaatttaactagattttttttctgaagatagacaaagatgagctcaattttccaaatcttgggaggagcctgtgatttctttagacttcagaggaagtgtataagtgtagtaattcacaatcgtaactttcataggagcagaaatctgcaataatgctaattttcactcagtacttac

SEQ ID NO: 5880 - DNA, 254 bp, Homo sapiens
atgcaactagatgccactatgttctccctattccacaccaagcactgtgcccaatcaacaccagaaaacagagaactgaaacagaaaacacttaaggataacccaggtttcatttgtttgcttgcttgttggtttagttggagaaagcaggggacacacaaataatactttaatagaactctgactgtgattgttgtaagagtgataatgccctaaatgacaagcaatggcagaggaagggagaaagtaggtta

SEQ ID NO: 5881 - DNA, 419 bp, Homo sapiens
agcattttcattttgtagagcatacatgtccccaagcagtgtttgaaatttaggtttctaatttatgtagaacttaacatacaagagtgagtacactagactgaattagtgcattcagtggaatacagattctctttagacccattttgccttgtctcgccatacataccactgttgcccaccttcattgtatattttattaaaggttcatctctaagttgaaatggaaggactgtggatatgaaacaaatttcaggaaaggagcagaccacactcgttggaactgttagtaagatcaagttctgaataaccatgaaagacgttttgtgttttatttcataaacttatatctaaaagggtgatgattaagatatgaggtgagctctaaccaaatccatattagagaaagcaaaatcctt

SEQ ID NO: 5882 - DNA, 441 bp, Homo sapiens
tctcccagcagtcctgtgcttccctgttacagagtgccccccagtctgctgtgatggctgtggccctgcatctcttccaaatgaaatgagagctggaggcatggctcactccatgatacagatctagtccctagaacagaactaggctcctatggggaaatgcaataaggacagcgaacaaagaaagggagaggtagaaggaagctcagaagtttaaaggactcagtctggcagaaaaagaaagaggggttgaggagggagtgagatgaagggaagttgagtgcaaggaagttcagagggggaactctacagaatgcacatggaaaataaagttaatcagcaaggatggaaagatatcttaaacgtcaacatcaacagaaaaaagacctaactgtatatcaaattgaactttaataatttagtggaatataattttaatgg

SEQ ID NO: 5883 - DNA, 308 bp, Homo sapiens
gcatgttaatattttacaagtagctctcattctttaaccttaaataaaaatgttagcatttcaaatattttcatagttatacaaagacgcagaatattttacttcacactataagatgcatttagacagtaataaaaggcaaaaagtcttggggttgacttttcaattctaagcaactaaactaactaaattttagacatggaatgcctccaggttaaaactgttttaataccatcagctactgataaattatagttaaagcaatagtagtgattaatgatttgaaaataatccttaagattttgctc

SEQ ID NO: 5884 - DNA, 341 bp, Homo sapiens
gacggggtttcactgtgttagccagggtagtctcgatctcctgacctcatgatccgcccacctcggcctcccaaagtgctgggattacaggcgtgagccaccgcgcccagcccataaaataattttttaaaaaatacactcaggcacaagaaagttaacttacacgggatcatatagctaacaaaagctgggatttgaacccaggttgttcaaactcttgaacaatgctttactgcctcttcaaattcagtggtctttttccccaaacaaataataagttccttgagagcaaataccatgaatcacatgtctcatcctcaagcacctagcctagggtcagg

SEQ ID NO: 5885 - DNA, 2070 bp, Homo sapiens
agcccaagatttctagggcattggcgcgctgctgggtgacttccgggctcaagttgcaagggggcgggccgggccggaggtggagtctcccgccaattgaagcctccgctataaattgaactccctgcactgctgaagcccagatgcctcgccaggccacgtcgcggttggtggtcggagagggcgaggggtcccagggggcttcggggcctgcagccaccatgctccactccctgctgcttcactccttgaggctctgcgcccagaccgcctcgtgcctcgtgctcttcccgcgcttcctcggcacggccttcatgctctggcttctcgatttcttgtgtatccgcaagcatttcctgggccgccgccgccggggcaagcccgagcccgaagtggagctcaacagtgaaggcgaggaggtgcctcccgatgacccgcccatctgcgtgtccgacgacaaccgcctgtgcaccctggcgtcgctcaaggcggtgtggcatggccagaagttggatttcttcaagcaggcgcacgagggcggtccggcgcccaactccgaggtggttctgcccgacggcttccagagccagcacatcctcgactacgcgcaagggaaccgcccgctggttctcaatttcggcagctgcacctgaccaccgttcatggcgcgcatgagcgccttccagcgcctggtcactaagtaccagcgcgacgtcgacttcctcatcatctacatcgaggaagcgcacccctccgacggctgggtcaccacggactctccctacatcatcccacagcaccggagcctggaggaccgggtcagcgcagcgagggtactgcagcaaggtgcacccggctgcgctctggtcctcgacaccatggccaactccagcagctcggcctatggcgcctacttcgagcgtctctatgtcatccagagtggcactattatgtaccagggcggccgtggccccgacggctaccaggtctctgagctgcgcacttggttggaacgctatgatgagcaactgcacggcgctcggccccggagggtgtaaacatccaacggacaattgactgaacttggtgggctgggccttcgagccttcgaagcccacgtgcaagcgcctcaaaccaagtcacgcttgggaggccccagtgacactgatgtgctgagccaccatttcagactgagtctgcaccctcagccacatgaacaatctcccctacctccctgggactctgcttctgtaactgtctcattcacacctgctggcttgcccttgtccgtgtgcccccaggactttgcctctacagcattttcttacaccccctccccagcgtgccctcagccaagtgctttggcccggtgcttcccgcagctgcacagagaccttggccacgcccgcgcgccctgagcgcagctgggttccaggagactctcagctcagctgagctagttgcctggcacccacctgtcgcgcgcggagagggggttccctgttgcttttgtgtctgtttcctgtccctggtaggggaagtgatgtcgtggatggggaggggtgggcagagtagtttcccccgcttgttttgggtgcacaggagccccactgctgatgacgaactatctctaactggtcttgaccacgagctagttctgaattgcaggggcctcaaagcagcacctaaaccttgagggggagggtgctctgggtttccgtgaggtaaccaccttaaatgggagggaagttggggtgtctgctttgggaccagaggaagatagcttgagaggcattggcgaggttcgcagcgccccagggagagagaaaaagctgagactcctggggaatgacgttggggtgatggagtccggggaaagagaggtggggggagagcctgaggtccccaagtgaggggagtcctaggcagagctgctgattgtggggctgggaggtggagggcccctgattcgaaggccatttggtgagtgttttgctggaaatatttcctgtatataaacttctttcaatctacaataataaaggcttgaggtaaactgcaaaaaaggaa

SEQ ID NO: 5886 - DNA, 94 bp, Homo sapiens
aacaatctcccctacctccctgggactctgcttctgtaactgtctcattcacacctgcctggctcactggaaatcctcttttgagcgcgggata

SEQ ID NO: 5887 - DNA, 408 bp, Homo sapiens
aatatatttaaggttttaaggcagattgccctattagatctataattcatcatctaacacagtacagctactgcctttctttaaaaagttaaaattgctgaatctcaaagcaaagctactgacaagtttacatttgttccttaatttctgattattattattattattattagtttttggcaagaaaaaatgtaaaacactttccaaagtatgcagctttaatttttaccataataattaactttcttctctgaattactgattataataggaccacactgtatagcatttgaccttgtgtgtggtaacttttacttcctgactatattataattaaaggtaggagagatgatttatgttatttgtgtctctttgagatgctttacttggatttgagaacatatcaca

SEQ ID NO: 5888 - DNA, 468 bp, Homo sapiens
cgttgtcctgccgagcccagggcgttctgttccgggcgagccttgtgctgcaggggcatcagcatgcaggctgccccgggagggtccaggtgctgcaggcagagttcaacgtggggcttgtccgccctcccttagctctggctcagtgcatcctactgtggggacatctcatgaggggacacgaagtcactgatctcactcccagtatttggagctgggaacccaaatagtgtggcgcaggactgatctgtgcctgttattttggttgtgagtcattgtcctgtggaattggcaaaagctacatttttactgtccttaccagcaacggttcgtgttgtcacatgctgtgagtgcaggctgtggtgtgtccttgtgtgtacatgtatgtatatgtatacatcatgcacaaagcatgtcatgctgctgtccagcggtgaagcaacaagtacaataaaatgtggctctaaa

SEQ ID NO: 5889 - DNA, 456 bp, Homo sapiens
catcaaacaaatcagacttctgccttggagtcgtcatatgtctaacctccctggctattttccatgaaaacatcattggaaagaccaagagcttcagttcccctgcttgtgagacttgaaatgttacagatcagggaggattatcttaaaacaaaagcctccttacacaaggacatgcccttggcaaagcaacacctcaaggtattcagcaatggaataaaagatctattttgactgatcatgtgaaaaactctgagaggccatatatgtttcagagattcctgtggggttggcctaggccttacctggcctgcatcacagttcaacctttttttttttttttttttttttgcttacttatgctcctccttttctcttttcaaatgtcaattttaataaatacataacaccgcagtccttactcaatgcctgcttttaaagatttcatcctgtggc

SEQ ID NO: 5890 - DNA, 315 bp, Homo sapiens
gacaggagtagtcaaatgactaagttctgggcaatgagatgtgagcagaagctgatggctccagctcccaggggctggctcttccctcctgcctccttacagtgagtgggcatgctgtggccatcttgcaaccatgcagtgaacttaaggatagaagatgcgttaagggctgggtgcggtggctcactccgataatcccagctactcgggtggccgaggagggagaattgcttggacccgggaggtggaggttgcagtgagccaagataacaccactgcactccagcctgggcaacagaacaagactccatctca

SEQ ID NO: 5891 - DNA, 324 bp, Homo sapiens
tggatgtggttttctgagggccctatcggtgtgagcccagcccatttgtcactaaggacagctgtggccccttttggcttctccaaaggtccatgcccctcctactctgtcctcctgtacaaagtctcagaaatgacttcggtcttcttccccgcctctgaggattgatgggagctgaggtgtggggacccatcccctcaggtacactgcctcatagtatttcttctccccgcttggctgagcctcctctcttcagatggctaaaacaggcacaacccccacgttgccacacagtcccataaactcctatggatacaggtcagt

SEQ ID NO: 5892 - DNA, 162 bp, Homo sapiens
aaactaataaacttagccaggtgtggtgttacatggctgtaatcccaactacctgggaggctgaggtgggagaatcacttgagcccagttgatggaagctgtagtgagccataatcacctcgccgtacctcagcctgtgtgacttagggggactctgtctca

SEQ ID NO: 5893 - DNA, 466 bp, Homo sapiens
ggtaaatacctaggagtggtgttgccagctcagtgagtaggattttatttaacttactacgtttcaccaaacagtttttgcaaagtggttctatcattttacattctaccagcagggtatattagagttctcttttgctccacacactataagggttgatattgtctgccttttaaattttacctgttcttgaaggtgtaaagtattatgtcacgatgttttaatttgccttttcctaatgatcagtggtattgcgtatcttttcctgtgcttattagtgacttgtatgtcattttttgtaaacatctattcagatattttgttcattgcaaaaataggattatttatttatttatttatttagagacagagtctcactgaatcgcacaggctggactgcagaggttgcagtgagctgagatctgcgcccctgcactccaacctgggtgacagaacgagactccat

SEQ ID NO: 5894 - DNA, 3094 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5895 - DNA, 637 bp, Homo sapiens
gtggggcccgtttaagaattagggattcccccggggctgcaggaattcggcacgagttgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5896 - DNA, 1441 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5897 - DNA, 3202 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgctggaggcacagtggcccctagaggctgggcttgggagaagaggaactgcctgggcagggctaggccaggccaggctggtgctacacagcgccccctgccgcccacagtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5898 - DNA, 3145 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgctggaggcacagtggcccctagaggctgggcttgggagaagaggaactgcctgggcagggctaggccaggccaggctggtgctacacagcgccccctgccgcccacagtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5899 - DNA, 3012 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5900 - DNA, 3216 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcaacacaacaaacaacaccgacgcaatacacaaacaacaacccaggggggcgcataaaatacccccagcggggcagcgagtggcacacaccccttttgcacaaggggcctcaagggggcgcaag

SEQ ID NO: 5901 - DNA, 2205 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5902 - DNA, 1917 bp, Homo sapiens
cagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgaacctgctcttcagcgtctgtgggctcaccatttgtgccgctataatctgtacactctctgctattgtctgctgcatccaaatcttctccctggacctcgtgcatacgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatca

SEQ ID NO: 5903 - DNA, 419 bp, Homo sapiens
tccaaagtctcactcctccaggggtgtcccgtagtcaagaggttgatgctgatgcctgtggaaagagcggctgaagatggcttctcaggctttcatcttgacctcctcctcttacttcacactcgccctgggctccagcctcagcacccaagacgtcaaccacctcccaccaggcttgcgatgccaaatctttatctctagcctgactcccagcaccttccagtcgtctgcctagagtggaggctggctggctccagttccctttccaacagcagccagggtggcctgcctcaaacgcacacatctggccacagcactcgcccacgcccgcgtaggagctggccctggtcaccgtcatccacgtcagagatcacaaacatttggaaatgtaacttgtttttcaaataaatgttatattc

SEQ ID NO: 5904 - DNA, 476 bp, Homo sapiens
aacaaatgttggaaaatatttttaatgatgtaaaaatagtccactggatggagatatcataatttaaggaatctaatttttcagcaattttaatcacatctaagtactgctataagactttgatggctgttattactgcataatatttacttgtttcatctttagttttttctccaacaaagttgtgtcccattggctgacttctatttttacattaattagcatatttttaaaaaatcaacttaaaaatccagatttgcaggtcctcttgagaagagacaatcaggtacagccacttagtgctgcctcctttagttgtggtatgagctcctagtaatctcatttgttatttgcctggcccatctgtaagcgctgagtcaaggaacacgtctgcttcctaggcatatccttagggcccagaaagcacactgcctggcataaaggagctaagtatttattgaaaggaaaagcaaacc

SEQ ID NO: 5905 - DNA, 470 bp, Homo sapiens
aagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtctccaaaaaatgaaaatcaaaacacatagccaagagccaagagacgaggaagaacattctcatatcttttcagcatttggaggtggtggtgattgtgagcactttagactgagccaacttgacctaatatggacaaaggaccagagcttttggttatgggtattcatcagcttcctttctcagcatgcataattgggcttatatttatgtcattgttgctgtacgattcctacagctgtataatacctaagaactttacttattcaccatctctttttt

SEQ ID NO: 5906 - DNA, 382 bp, Homo sapiens
gaataaagtagctatggaaatatatcttgaataatagtgtatttttgtagaaagatggcaaattcattattaaaattaaagagaatgtgaattataagaacttcagtaaaaaacttattcttcatgtttcctttgatgctgctgcatgtgttgtaggtgtagttatatccaactttaccattggctttgaaatacaggtccaagaaattctagaaatgaataatcaaaaaaatatgtcagtgtataaaattcccaggcatacaaattatccattttcaaaattggccaattttatatgctcaaggaatcttcagaatatcttttcacaccttctcatttctttacaagccttctgaaactaaaaattccagtggccccaaag

SEQ ID NO: 5907 - DNA, 1146 bp, Homo sapiens
ccgagatcgcgcccttgtgcttggacaacaagagcgaaacttcgtctcaaaaataaaaaataaaaaataacctgaataaccatcgtctgtctgctccctaacactcacaggattagaatttctggggatagtacttaagctaccaaagaggatgccatcactcagagatatagaggtgatcagaaaactgcaaaagagaccttcttgtctttttctctaccaactgttatgatttgtcattgccactagcatgtatttggcaaaacttgctatggccttgtttgtcttccttctataaaatgaatttgttctaaaatttggaaatagaaattactgtttttgttctttcagtatattccagtgggttgctgcagagtaatatttttatgttttcaatgcttttagtttacacttaaatgtttgtgttggaaatgtcttttctgctaattcagttattggaaaagggctgtaattgagtagggtagtaaatactaattgcttgtttctttaactgaataacattttcctattgttaacggattgactacaggtgtgctgtttgactttctattacttgtaactgaagttagcctctctcctctacccccgcaaaagtgtaggagactgggtgatggtcttgtattctctacaagttggtggcgttgtttaggccccaagctggaatgctgatgaccctatgattctctccctccaccctttacatctgttttatcatgcaagttctgatgatttttagactatttttctaggctctgcttcacacctcattgacacctatcttccctaattaaggtcttttttttctggcatgtatgttgccctattaacagtagctttccagagggtacatggctcacacctgtaaacttagcactctgggaggccaaagcaggaggattgcttgagcccaggagtttgagacaagcctgggcaacacagggagactcttatctctacaaaaatttaaaaaaataaaataactgggcgtggtggcacacatcttatagtcccagctacttgggagactgagacaggaggatcccttgaacccaggaggttgagggtacaataagccatgatctaaccactgcactccagcctgggtgacagagtgacactgtctca

SEQ ID NO: 5908 - DNA, 511 bp, Homo sapiens
gaggacaagatgacacataatagaggagcctgggctcaccgtaggagaactgggttaggagagagaaagcctgagcccttcctggacttgtttgccctgggccagggttttacaaaacagcatctctctctctctccctaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagcccagggccctgtctgtctggttctgtgcagcaggttgggaagaaggggactgcagggtcctgtatatcaacgcacactggtagcttctgcttccccttccactccgtcaaaagcactaagttaggccaggcacaatggct

SEQ ID NO: 5909 - DNA, 994 bp, Homo sapiens
ccttatgcttctctagcttgggaggacttacgggcggacgggttgtgtctcgtttatctgttaggttgattgtctagcacagtgccaggcacatagtaggcattcagtttttgtggagggaacagaggctgcggcctcctgtcattgcaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5910 - DNA, 1800 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5911 - DNA, 2503 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5912 - DNA, 2151 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5913 - DNA, 2065 bp, Homo sapiens
ctcccggcctcggagcggacggatccgggagggagccaggcggcccatggggaggggcaggggcttagccgctggcgagtgaggaccgggtcgggagaaaggggtcgcacctggagttcagcctcttgggtaggggcgggatacgtggggcgactcgaggagctgccaggactagggagggctgcgggccaagacggggcgggatctggatgacgtttgcctctaagacgccacgaggaggccaggctttgcaaccatctccataaagaaggggcaagttcgaggacggaaagcccactcaaagggcggggggcggggcctggcaagagggggtgtggccaggatcccaggcagtaaattgtgcggcggggtctggatggaaaggcggggcccgctgaaagaaggcgatccgagttctgctacttcctagtaagggacgtctctggagagattctgaggtgtttgagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5914 - DNA, 1904 bp, Homo sapiens
cagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5915 - DNA, 2379 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5916 - DNA, 2645 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagcccagggccctgtctgtctggttctgtgcagcaggttgggaagaaggggactgcagggtcctgtatatcaacgcacactggtagcttctgcttccccttccactccgtcaaaagcactaagttaggccaggcacaatggct

SEQ ID NO: 5917 - DNA, 2029 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcagagcccagggccctgtctgtctggttctgtgcagcaggttgggaagaaggggactgcagggtcctgtatatcaacgcacactggtagcttctgcttccccttccactccgtcaaaagcactaagttaggccaggcacaatggct

SEQ ID NO: 5918 - DNA, 632 bp, Homo sapiens
ggagccggagtcagagccggagccagagccaaaggccaggacagaaacgccgagaggaaccaagatgacccttgttggggcattgagaatatcatgagtgccacggggaaggggagtagggatgtcttttccccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgagaagcaggaatctccctgtatctagctcagacggccaggggcacggccgcccctggcgagggtcctgtctatagcaccattggtttccacgatttcaattggctgagaaggcagagagctagctcctccctttctttctttttccacctgagacttgtttataaaaaacaaaacaataaaaagagtctgatcagagcccagggccctgtctgtctggttctgtgcagcaggttgggaagaaggggactgcagggtcctgtatatcaacgcacactggtagcttctgcttccccttccactccgtcaaaagcactaagttaggccaggcacaatggct

SEQ ID NO: 5919 - DNA, 2086 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacgaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtgctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5920 - DNA, 2669 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggtatgactccaactcctgaaaccccgtttagccctgaccagggtatccccaaagaggatcctcctccctgaccctctggcacctagcccggcacttccttctgacctgtctcatctctggctctttcctgcctgttctccgggtgtccccatcctattctcctcaggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5921 - DNA, 2212 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5922 - DNA, 1885 bp, Homo sapiens
ggcaagccccccactggggtagctgtgcctgccgggtcgggaatgaccctttcccagttccaggtttcgggcccctcctcccctcacttctctgacccccacagcgtccccgccggacctggagcccgggctggaggtgggcgcggggctggcggtgcggctggcgagggtgctgcgagcccgccttcctcgcgggcagcggcgcagcctgcggggcgctgcttctcgggctctgcgccgcctctactggcgccggaaacagcgcaaagagctcagccactacacggcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5923 - DNA, 1581 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5924 - DNA, 1519 bp, Homo sapiens
  misc_feature (26)..(26): n is a, c, g, or t
aagcagctggtcctgccccggagtanggatggccgctgaaagaaggcgatccgagttctgctacttcctagtaagggacgtctctggagagattctgaggtgtttgaggtcagtggttttcaatcttggttggctacacataggaatcacttgaggggcttgagaaaaataccgacacctgagtcccacccccgagaaattctgatgaaatgggtccagggtgcagcctgagtggtggaactgggaccggggcctaggcgtggacaagtataggggtatttctgacccttctcctcatttcacctcttctttctcccacgggttcctttctggaagcctcttttgcctacacaccggcaggtaagccatctctgccccagtggggttcagaccccccgggacgggcccttctctcactcattcgccccctcattttccccagtgtccttcccgcactcagagggcctctctggagccagttccaggtaattctcttagcccatttcctcaggatgacctccaccgacaggccactcttcttccgccccgctgacgccccaggtggagggagcatggccacctcccaccccaacaccaccgccactgtcctgaaactcccgaatatcgccacctccctttcctttgctggcctcttcaggctctccgtccccaacgctcacctgctctccctcaggccacccatgggccttggccccgccccctactcatggctggcagattcgtggccccacccatctcgaagcccctcggcccaggaacccaggggaagctgctgccctagcaatcctgacccggacgacagatattacaacggtgaggagttctcattccctcacctggcttcagcgcacttctcccgacctactggggcaaaccgaagggcgcccgggagcccggtctctctgaggttggtcagtccctggggaggatgtgagctggggaagcctctcagacctacctccaccctggtttaggatgtaaggcttgtgtgggggaagaagttgatcccgtgggatttccctttgtcttccattctgttgtcctctatgtttctgtctctgcttccgggcctccctctttcttctctgcagaagcaggaatctccctgtatctagctcagacggccaggggcacggccgcccctggcgagggtcctgtctatagcaccattgacccagcgggggaggagctgcagaccttccatgggggcttcccccaacatcctcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaacaaaacaataaaaagagtctgatcaga

SEQ ID NO: 5925 - DNA, 428 bp, Homo sapiens
ggttgactaaaaaaaaaaaaaaagtaaaggaaagccatcttagcaattgagactattaaaaccacaataaaataccactagacacccaccaaaatagctaaaactaaaaagactgttactagcagttctggacatgatgtagaacaatcacaacttatatacactgctggtgggagtataaactgtacaactactttaaaattaaacacatatattttggtaaattgcaaaaatgactccaattcttcacctctcactataaacataacctttgaagtgtgactttgcagcatgttccatcaacaattagaatctacttccctattccttaaatctggcctattctttcaaattcctttggccaacagaatatgatgaaaataacggtgtgcctgttctgtaccagatctccaaagacctatcctaca

SEQ ID NO: 5926 - DNA, 347 bp, Homo sapiens
taacaggttagccaagctaccgatctattgcctgaaaataaatgagaataattttggagctaaaaaaatttagtatctaaatttttgtaaaggatctagctggaattctaaatataaaatgtgttaacagtcaacaaagaataacacaacaaatatcaaattttctctggtaggaaagtagataacttgaaaatcatcatcacatctctgtggaatttaggtaagttatggtacagaatctttgagtccaataagctgagctattttaaacctaattgtgcacaactatgtaaatgtttgaaaacctgctcccagtcaacagcaagaaacactgtccagaaaaattg

SEQ ID NO: 5927 - DNA, 1025 bp, Homo sapiens
  misc_feature (67)..(67): n is a, c, g, or t
  misc_feature (70)..(70): n is a, c, g, or t
  misc_feature (74)..(74): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (89)..(89): n is a, c, g, or t
  misc_feature (93)..(94): n is a, c, g, or t
  misc_feature (102)..(103): n is a, c, g, or t
  misc_feature (110)..(110): n is a, c, g, or t
  misc_feature (115)..(115): n is a, c, g, or t
  misc_feature (124)..(124): n is a, c, g, or t
  misc_feature (135)..(137): n is a, c, g, or t
  misc_feature (141)..(141): n is a, c, g, or t
gctcgctgccgccgaggctccaattttcgtctgtctgctttgtgtcctctgcacgtagaagcccagnctntgtngccntgnganctgcnggtnntgggaganncacagcnaagangccagggcnccctggaagcnnngaantgggagcgttgacatttagagatgtggccatagaattctctctggaggagtggcaatgtctggacaccgaacaacagaatttatatagaaatgtaatgttagataactacagaaacctggtcttcctgggtattgctgtctcaaagccagacctgatcacctgtctggagcaagaaaaagagccttggaatttgaagacacatgatatggtagccaaacccccaggaactgctttcagcatcttttatatgtttgtgaagttttataagtatatgcagtgccaatatactttttcagaatttggctattttggaacatcattttttcatttttcaggacagatttgctgatggtgttactctcacttgaaagctattttttttcccaggactttgactgcatcacacagtttctttccggcctacaaaatttttgttgacaattcactggttatatcgtaagactatgtttgtatatgacacatcacttttatcttgtagctcccaagatgctctgtgacttttgaaattgtgcttatatatgtatttgttataaatattttgtatgtattctagtttgtttgttaagcttcttcatgtttacattatttttcttactgagggatttttcaggtattatttcttcttgtattttttacccccataatttctattttttaattttttcaatatttttgttcttatcttcatttctgattttctgtagtctgtgttcctgtttcactcattgaatattcaattttttatcaatttttaaaattaatgtgtacatcttttctatggtttccttctgaaaattttataatatttttgatggaattatattgccctgttttgtatatattgtaatctttaattgagatt

SEQ ID NO: 5928 - DNA, 1060 bp, Homo sapiens
  misc_feature (102)..(102): n is a, c, g, or t
  misc_feature (105)..(105): n is a, c, g, or t
  misc_feature (109)..(109): n is a, c, g, or t
  misc_feature (113)..(113): n is a, c, g, or t
  misc_feature (116)..(116): n is a, c, g, or t
  misc_feature (119)..(119): n is a, c, g, or t
  misc_feature (124)..(124): n is a, c, g, or t
  misc_feature (128)..(129): n is a, c, g, or t
  misc_feature (137)..(138): n is a, c, g, or t
  misc_feature (145)..(145): n is a, c, g, or t
  misc_feature (150)..(150): n is a, c, g, or t
  misc_feature (159)..(159): n is a, c, g, or t
  misc_feature (170)..(172): n is a, c, g, or t
  misc_feature (176)..(176): n is a, c, g, or t
ggtcgacgtctctcgctcccgccagagcttgggattggtcttcactgttccgcgtcctctacctgggaaccaccgacccccgcccggcgactttgtcacagnctntgtngccntgnganctgcnggtnntgggaganncacagcnaagangccagggcnccctggaagcnnngaantgggagcgttgacatttagagatgtggccatagaattctctctggaggagtggcaatgtctggacaccgaacaacagaatttatatagaaatgtaatgttagataactacagaaacctggtcttcctgggtattgctgtctcaaagccagacctgatcacctgtctggagcaagaaaaagagccttggaatttgaagacacatgatatggtagccaaacccccaggaactgctttcagcatcttttatatgtttgtgaagttttataagtatatgcagtgccaatatactttttcagaatttggctattttggaacatcattttttcatttttcaggacagatttgctgatggtgttactctcacttgaaagctattttttttcccaggactttgactgcatcacacagtttctttccggcctacaaaatttttgttgacaattcactggttatatcgtaagactatgtttgtatatgacacatcacttttatcttgtagctcccaagatgctctgtgacttttgaaattgtgcttatatatgtatttgttataaatattttgtatgtattctagtttgtttgttaagcttcttcatgtttacattatttttcttactgagggatttttcaggtattatttcttcttgtattttttacccccataatttctattttttaattttttcaatatttttgttcttatcttcatttctgattttctgtagtctgtgttcctgtttcactcattgaatattcaattttttatcaatttttaaaattaatgtgtacatcttttctatggtttccttctgaaaattttataatatttttgatggaattatattgccctgttttgtatatattgtaatctttaattgagatt

SEQ ID NO: 5929 - DNA, 775 bp, Homo sapiens
ggcctcgccctgcttcgactcgcgcatggtgcgcgcacgcactgacctgcgcccactgtctggcactccctagtgagatgaacccggtacctcagatggaaatgcagaaatcaccagtcttctgcgtcgctcacgctgggagctgtagaccggagctgttcctattcggccatcttgtctcctcccgtgaactggaaattccctgtctccccttaaccagcactggaagcagatgggaagagaatagctgtgactgactcacactctaacccagcaaccctcagcatacaagtgggagaccataaagtttttcaagaccccaaaagaggccaaaggtctgataattgctgggagaaggtccactatccaagaagagaagaggaaaaggaattaaagtctccaagcactggggatgcaagaagagagttgcacaggagagaaagaagaagttgtccacggggtgaccctgcaattggagggaaatgcatgtggatatgtgcagggagtctaggaagtgaagccttagtgagtgatcatttacaagaatgagggttaggtaaaataagggatgcaaagccacctgtagtctattctaacctcactccatcactctatacaatctgtgttttatcatctgaaatgttaagtaaagacctgtttgggtcttcttcagaatcccatacatttgagttcattagtcagaaaaagggaaaataccaccaccccatcctggaatggcagtcatgtacacttttataatgagagattgggcagc

SEQ ID NO: 5930 - DNA, 878 bp, Homo sapiens
ggcctcgccctgcttcgactcgcgcatggtgcgcgcacgcactgacctgcgcccactgtctggcactccctagtgagatgaacccggtacctcagatggaaatgcagaaatcaccagtcttctgcgtcgctcacgctgggagctgtagaccggagctgttcctattcggccatcttgtctcctcccgtgaactggaaattccctgtctccccttaaccagcactggaagcagatgggaagagaatagctgtgactgactcacactctaacccagcaaccctcagcatacaagtgggagaccataaagtttttcaagaccccaaaagaggccaaaggtctgataattgctgggagaaggtccactatccaagaagagaagaggaaaaggaattaaagtctccaagcactggggatgcaagaagagagttgcacaggagagaaagaagaagttgtccacggggtgaccctgcaattggagggaaatgcatgtggatatgtgcagggagtctaggaagtgaagccttagtgatcattccctatttattcaaaatctgtgctacctccactgcgaagacttccacgagaaaattcagatatttcttcttttgtggacactttctaccttacaaataagttaattttaattcaaggaagagtttttccggaaccctgttggcctgctcacaggaatgtaagttccttaaatctagggcacagtgtctttgagaactgcaatcacctacatcaacatgacatagctattaggactaagaacagagaccacctgtgtcaacatgagttactatttttttccgtgaaacatttgtccaagaaagataagactgtaaccaataaatagtttgcaagtaaaaaaaaaa

SEQ ID NO: 5931 - DNA, 107 bp, Homo sapiens
gcatataaaatccagtttatatatctggattatattgcaagaaccattcaagaaatgtgccatccatgttccaagtataaaaatagaaattttaagacagcgtaaca

SEQ ID NO: 5932 - DNA, 387 bp, Homo sapiens
ctgaatttatttttcaagtaaaatggtaatagacatatgtggtatgactacctagttatgaaggttaaaagcagaggtacattgtttagtacctattgcacgtatacgtggtaaaaatgtttgtggtttccaaaaaattcaggagtgtggtaaccttgggtgagagtgaaggaacacaggagtttctgggaacgggcactgttctcgatgactttggcagtggttacctggtgtctgccttgtagttatttgtgatagttaatgtcttacagacttttctgttatgtttcacagtttaactattttttaaaaatgagtgatgtctttggccaaaaacttcaaattgagttacttttatcttctattttaaaaagctggagtcacatt

SEQ ID NO: 5933 - DNA, 520 bp, Homo sapiens
ttgtgtgacttctgcctctcttgaatccactgatcccctcaattgcacgatcaggcctactctagtcttgagcaactcagaccaaagctggacgtgttgggagacaatatgtgtatgtggtttttacaagcctgctgggaggagtgagacagacctgggccaagacccaggtgtgtgctgtgctagccgtgtgaccttaggtaaattcattaatccctcagttcagctaccatgggctggatccaattaaaagaggacaaatcactgaaattcagccccatcagccacttgttgagctttcctgacgttacctcccatacctgtctggcttcttccttcccttttccctgtctccctgctcccactattcttgtactgccctctggctgccccatccaggcactgaggctggggttgctaccttattcccaccttgccctggtgctctcagagacttcacttttcaccaacccatcattccttgccctcccttccctttactcactttctcctttctgcc

SEQ ID NO: 5934 - DNA, 303 bp, Homo sapiens
ttgtgtgacttctgcctctcttgaatccactgatcccctcaattgcacgatcaggcctactctagtcttgagcaactcagaccaaagctggacgtgttgggagacaatatgtgtatgtggtttttacaagcctgctgggaggagtgagacagacctgggccaagacccaggtgtgtgctctcagagctagtacggggctctccggcccgtcaggggactatcgggctagtcggggacttcgggctagtcggggctgtcgggctagtcggggctgtcgggctatcgggatgtcgggctagtcgg

SEQ ID NO: 5935 - DNA, 447 bp, Homo sapiens
aagacaataacaacatttcttagtacgtgaagctggactcagaagtaaattttgttatagtgtttttcaaatgcaggcttgctttcttcaagttaagaaggcatagtgtgaatttaaaataaatgttatagaaattgaacgagaaaaaatactcttcagattatataattttctatttattatatttatggcagaagatagcacatccaattgaagaagtcatattaaatcaatagtggtgatcataataattgaaattcattctttgccatcttctggaagagattaagcctttatatatcttgaaaaaataataatttcaatacacatttttaatgccactcatattcagataatcactaattgtaaaagcctatgtcttgctacttttgcttgaaaattggaatacatcctcatagtgcttaataaatatttgttgagcagaca

SEQ ID NO: 5936 - DNA, 332 bp, Homo sapiens
aaaaatgatctctgaggatttttttgtttgttttttaagagacagggtctttctctgtcacctaggctggagggcagtggtacaatcatatctcactgtagcctcaaactcttgggttcagtcatcccacttcagcctcctgaatagctggtactactggtgcataccacctcgctaatttattttatttttttgtagagatggggtcttgctctgttgctcaggctgctatcaaactcctggtctcatgcgattctctctccttggcctcccaaagtgctggggtaatgagcatggccactgaggatttctaagatttaggactgtgtagc

SEQ ID NO: 5937 - DNA, 424 bp, Homo sapiens
ttacatggcctcaaaaacccaaataagaaatgggcttttcctctaggtcacggataatttttagcagaaatgcagagaaagcaggccacagaagtagacataaagtataggaagtgcagtattatgagagctcagagaggagtggtttgtttgcagcaacaagggtgggagttgagaccaagccaggcagtttcaccagagaaacacttcccttaggtcagaggctcttggggagctaagggttcctcacagctcaccttgccctgctgcctgacccactgggagactggggcctataggtgaccacacttgctggcaccatacacagccaggtagaaactgatcctgactgccagaaggactcctgattccttccccagtctccttagaactgtggccctcatcagcgaacagtgaggaacta

SEQ ID NO: 5938 - DNA, 442 bp, Homo sapiens
gctcaaggtcagagtcttaacgagccaagcatggggactgcgtggaaagctccattcaggcaacttgactcccaagaccatgcttctggcacagcagacctgcagagccacaccaaacctgctagttaatagcagtgcatctttctggaggacaagagtttcatgtttgtccttcattccatactgaagtggaagaaatactttctgattcctggattccagatccttcagctctcatgagtaactgagcacggtgtctaggcagggtcttcagggagtgttctttttcatccaggtactagtgtcacgttagtgtccagtgataacctgttgattgcaactctgtagcttcctttccctcaaatacttctcactttctttctgatctactcagaagataatcaacataaactattagaaactgagttcttaattacttaac

SEQ ID NO: 5939 - DNA, 377 bp, Homo sapiens
taacatttatgacagatgttgatgaacaataactcgttggagctattttgtcatacttgagattttccagaaaatagaacaagcccacagaatgggtttaatctgccaaagcatctccctctttacaagcatctacacaggcctccagccctaagtactttcacctggacaatgttatgaagcttaatccagtactagtagcagaaagacttgtttactttggagctaaggagtgagtaggacacttaagactttgttttgtccttggactcaaggcaaactaatggttagcatcactccagttgttgctatcattttattactcatatgtagctatgagtaacttgagaaactgaaatgtaactgctgcatataat

SEQ ID NO: 5940 - DNA, 730 bp, Homo sapiens
ccggctctctgggggagagggaggacgggtatgccagccactaggtggtactgtggtaccttgctaattaacctttcccatggctcatgggtagtggagggcggaggttcttttccagcctctgtggatcaacttgtgatcctggggtggtgtgcctaagcccgtttccatagagtcccattttgaacacttttctgccagaggattatgttgccaaccatatgtaaagcccagttcctttcacatgccttttccagttgatctggtactcgttctgtcaggaagctgggccacgcttcatcagaaataaggaaatcagctcaaggtcacatgactcttgaggggtaaagctaaggacttgaccctcagaatccagaactctgtccttcagcgtattgtgtttcagtgaagggaaaattggccccacagacaaatataacccagagccagtaatggaggtcccaagaacacaggaaggccatgtgaagggtgctttcccttgagagtgtttactatgtgacaggcaagcagttttcacatattgtttcatttaatcctcacatgagccccatgaagtcttatccccattttcagataaggtgcctgaagctcacagagcttccctagctagttactgacagagccaggtgtgatattggactcttgacctggagcttgttactttgctgtattgctttaaccttaaccaaaagagacatgcctttctgtc

SEQ ID NO: 5941 - DNA, 438 bp, Homo sapiens
cgggcacagtaaacggcttttaataaagcagccgcgtttatgacctaaagatcctataaaagctgggacttgcaagagctgcgaagcagaaacattcatacatagtctattagacactcatttttgtaagtaggaggaggacaagtagtcttcgtgtgtccctcaaatttaatcagatcaaaggttgaatcatgctgtgtcgtgacaacagggtatttatgaggtgtgttacaagtacactggccaaacactaccaatgtcttctgcgacacacacacacacacactccttcctagggaatttacaatttcagcctcaaattcaccaaaccgtaaagaggatattaagccctccctttgaataagaatagcgatgttagtatgtccgagtctatcccggcaggaaacttttggcacgaatttcaacagtgaaaaggag

SEQ ID NO: 5942 - DNA, 595 bp, Homo sapiens
caaagcagaatcgacaaaaagaaaatcttcacatctttaagagacaaccatgttcagtacaatgacaaagaatcaaatggcactttacatgtatttgcaggatactgtgtcactcaaagtaatgggagggagagagaacagggagggtagggatgcttttgaaaaagctttttttcccacttttaacttgctttagcgttaagagtacttaccagctaataatgtggaggaaattattctttctcattggagattacagaatatatctattcatcttgaatacccacttgaagcctctgtagaaatgtctcgtcctccggttgtatttctaaaacctacatgattttgtcttgtttctgcagtgagaaattacatccatagcaaagacaaaagtctttttaaattatttttatttatctttcatatagttcttacaatttctaaaaaattaacactcatttagtatcacaatttatgggagagggttttttgtatttttaagcatatgtggcttatataaaaattgcagaagtcataggactgtcatgtattgcagctctgagaaccaatgcctgaaacttaagccaaaaaaaaa

SEQ ID NO: 5943 - DNA, 252 bp, Homo sapiens
tcttgtcaaaggaaaacattcatcttgttaaaggaaaacattcattttgctaaaggaatccccacttgtagccctggttattatttttgtctcagtactattcttgtttatagtttgtaaagagaaagactgaagaagtgtgaaatacggaagtgcatgtatgaattaacagggcagaattgggactggtatgcgtaagttaagagaaagtgcatataaatttatgtgaacataaagaggacttcttgtttt

SEQ ID NO: 5944 - DNA, 336 bp, Homo sapiens
aattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactcc

SEQ ID NO: 5945 - DNA, 385 bp, Homo sapiens
aaatgatgtagtctctaatttatgctttttgagtgatacgaagaactattcccaaatttatgaaattattgtgataagcaaaaacatgtaaatattctaaatgattccttactctatgttaaaataaaatagcgcagatctatctctattgtgttctatctggtaactcacaggagaaactcaccttgatacatacacatatgcatttttttcagtctcccaatttttggcattttctgcattagagataattgaagatgaaaaggagaaatgctttaagttcttgatgagaaagctatttgtactgatttttaaacagtgaaatgcgatgtaaacatgtttaaaagataagtgagaaactgagactaatataaagctttaatat

SEQ ID NO: 5946 - DNA, 492 bp, Homo sapiens
tacttcttctataatatggcaatattttatgtaaaaatagttatattttttatttgttccatcaaccaataatcttcagtttatttttaatgttgttacttaatatatttgtcattatgtatttgaatataaaagcaaatttttcttttgttatacttttagttagcttaaaatttattacttcccttacccattcatctaccaaactttttgcctttataaaagaggctgttctgctgtttacaacaacgctataaaattttgggatcgtgttctctttttgcctctgcaatttagctgtttactcaaggaagtagcatacatgatggactaaggatgatcagatacttgatttaattgctcccattcctgttgatttatgtagaaatgttaggccatgtaaaatgtcagtatttttaatgtattttgatcttagatatgaaagattttatatgcttctctagaattaaattttatatctttgaaaaaaaa

SEQ ID NO: 5947 - DNA, 257 bp, Homo sapiens
aaagtgaggcaagagatagcatattgcaaatacatggaagaaaccagattttgagtctacaagatctggctctggaatctgtgttcttaccttttacatagcttcgcagcaaagctaaacattctaaattgcaatagaacaatttgaaattacttccttcttaaataattgtattaaaaatgaaaaattaggtgcaaatggctgaaaagcaatgctctttgaaattcctttaatttcccattaagaatgaaaagtat

SEQ ID NO: 5948 - DNA, 354 bp, Homo sapiens
caaagtgctgggattacaggcatgagccaccacacccagccctgactaagtttttaaataattttttgtagagatgggttcttgccatattgcccaggctggtctcaaattcttggactcatgtgatcctcccacctcagcctctcaaagtgctgggattataggcatgagccctcatgcccggccattactatcattatttattttgtggctgaaattattccagacttacttttaaagagaaggtttccttgcatttacatccaattaagagaaaggactgcagtttctgtgttgttgttgttgttgttgttgttgttgttgttgttttggagaataccgtgtgatgagata

SEQ ID NO: 5949 - DNA, 379 bp, Homo sapiens
caattttttctaatacagaatataaaatatgtagagaaagatatcaaggctatctttagagaaagtctataaaggtgaacattattaataaaaaatagaaaatgaggggttgaaagcaggagttagaatccatattgtagggaaaggtgtgactgaaggggctgaagactactgagaataccactgctgcctccttgacagaaggtccaccatgacttgaggaatgattgaaattggagcagtttccatgaatgtcatgctggacaagggaaaagttgggacagtgaggttctgagttcatgtggtttttctagagtagacttccagactgtacgtaattcaccttggctgagagatgtcaagaacagggaattatgtc

SEQ ID NO: 5950 - DNA, 304 bp, Homo sapiens
aaatacaaaattagcctggcatgatggcgcatgcctataatcccagctacttgggaggctgaggcaggagaatcacttgaacccagaggcagaagttgcagtgagctaagatcgcaccattgcactccagcctgggcaacaagagtgaaactccatctcaaaaaaattaataataaaaagtacgttatagctagtttcttttttcttttttattctttttttttttttttttgcatcaggtataatcattacacgaacaacccctcagagtcagagtcccacctggccttgtaatctcagctct

SEQ ID NO: 5951 - DNA, 558 bp, Homo sapiens
tccatcactgattcctgtagtctgtagatgtctttttgagcaattcttctgggtcaagacttgttcttatttgctgggataaaacagcagtgagcaaaacagagctgacagcatggtgggaaggttgagctcttccagaccgtgatgagaagtattggtgagtggtggggagagtggccagaaggcagagtgtgggcgcagcatgagaggaggctttgtccagacttaaggacctggaaggccttgaaggccaggaccagggctccaattgtcctgctggcaataggaagccatatgggtgggggtgaggcagaatcagatttaggtgtggaaaagatgactccagccagtgtgggcatcgaagaggaggcacagaagcaggcgtggccacctgtgcctctgtgtaggagctgtgtgagcatgtgcttgaggatgtgtgtctgtgtagaggactggggtgtaggcgtgataggaacatggacgtgtatctatggaaagactccaattgtgcataggggtgtatgtgtgtaagattctgtggcccagggcagcctgtga

SEQ ID NO: 5952 - DNA, 1248 bp, Homo sapiens
ttacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgttgccagtcctaggcccctgccctgtaggaaggcagaatgtaactgttctttttgtttaacgattaagtccaaatctccaagtgcggcactgcaaagagacgcttcaagtggggagaagcggcgatatcatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccgcggcgggcccctggagccacactgtggccgcatgtgcatattgcagcctccgcccgtatctgggggccgcagccgccagcgcccggggacccagctgcggcgaaagctgtcgggcgcgcgcttctccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgcc

SEQ ID NO: 5953 - DNA, 523 bp, Homo sapiens
gtttttgttttgttttgttttgtttcctaaggagggggaggctctgtagaggaagcttcggccctgggtgcccctgggttgggagcagtcggggagcgctgagaccaggcgcacgccctgtcggcgctgcgggtgtggggcgcaggagtccttctggccggcccctccgccccccggggaggctggagctctccaaggccggggagtctcccgaagcgcgctgccccctctgttctccgcgtgctttcactagggccccatgctgcttagtggccgatttgcagggaatctgggcacaatcttaataacaccagggccaaaaataacaacgttcctgggaaccgagcagctggagcgcaccccatggacgctgggccatctccccggggactagtgcctgacagagctgacagagttctaggccacatgtgggctagaaggaaccgccatgtctaccacagcacagtccttaagcaggagccttttgaagcacttggactcaaaacaatggctgtttgttgtt

SEQ ID NO: 5954 - DNA, 139 bp, Homo sapiens
cagtgactctttgctccttgaacttctctatcccaaagcttgcatgacaatgctctcattcattcactcattcttcaaacatacatttcttgagcatctcttttgtgccatcctctgggtttggaattaaatgcaagca

SEQ ID NO: 5955 - DNA, 525 bp, Homo sapiens
aagactcggtctcaaaacaaaacaaaacaaaacaaaaaaactacttatgtggaatattaaatgctaagaggaaaaggaatggtgattactggttacaaaatacccaaatgtcctcttgttttaaagcaacacgatgaaattaaagccctgatgattagaaagttgaagtatatggggaagagggaatcactgaaaattttgtgccatcatttagctaagtctgatggaacactgaaaagtttcatgtgaacgtttctgggtaactgttggaaatagtttctctgactattggaataggtgtctacctctgcagctaattgtctaagaatattgtatagatatttttcattggttctttaccctttttacaatgaactcagttgagctgctgattaaaacatctagggtatgttacagagttgtgactgtaagaaggtttgactattacaatatacacatcaatcatatttataccaattctctcttgaatgtatcaggcaaattaaaagctttgctggttaaatt

SEQ ID NO: 5956 - DNA, 318 bp, Homo sapiens
ccagcttgtaattcccactggccaagaatcaatgcactgcatctattctaggtatcatgccagctgttcaaaggatggaatacatgatatattagccaagcaatggtatgttaaaaaaagaacggttactacaacagcttggaaaaagtgttaaaactggtttatcatgatagttctagtttttgaacaaaatataatctaccaaatgcaaatcaggctagtcctatgttcaaagctctttagcaagtagagttgctgagagaattttgaatgagttattatccagctacagaagagattacagtcaagtagcttcaa

SEQ ID NO: 5957 - DNA, 334 bp, Homo sapiens
atgtacttttggaggaaggcacttgggcactgcttgtataatagagtttgagaataaccctaaattctagaagagacaagcagagaccggtggaaatttatagtgtaaaccacgcttgcagaatcataaaactcgggtgttttctgttatatagtcagagcctcatattcaattcaagggtcaagaatgtgaaatgctggcaggtttcctaggacaaatatggtggtctgaaatcctgaacatctggctctgtctctcacagacacattatgatataaaatcctgaaagagagtaactgggtcctaaggattttttccagaagaaaagtgtcat

SEQ ID NO: 5958 - DNA, 350 bp, Homo sapiens
cactagaaatggtaacacgtgaacaaatacacacatttcattttcttatttgttaaaactctttaaaagaaaattgaggccctgagcagtggctcatgctgataatcccagcactttgggaggccggagcaggtggcttgcttgaggccaggaatttgagaccagcctgggcaacatggtgaaaccctgtctctactaaaatacaaaaattacacagacatggtggtgtgcacctgtagtcccagatacttggatgaggtacaagaataatttgaacccaggagccagaggttgcagtgagttgagattgcaccactgcactccatcctgggaaacagcaagactcctca

SEQ ID NO: 5959 - DNA, 708 bp, Homo sapiens
caggtggaagctcgggaggctcacgctggacacatgctgcacactctggctcccctgtggctgcagctgcacccacctacccagcattctccccacgacctgtccagcccaagcccacggcactcccaggggagcccaggacaccctcaactttttagtggattactagagtatcagaccacccatttatctctcagttcctcactcccacccctgcacccagcaagtcaccaagtcccccaggtgagtaaactggagctaacagcagttggtacttacggcatatactggatttggctcactcacacgtggtattcctatcttcatctactgtatcttcctggactacataagctgcaaagttaaaaactgcatttctcagattcccttgagctaggttccagacgtgatttattatcagtcaatcaaacacattcgcatgagttttgtatagggaacaatgttaagtcggaagaaaggcagaatgcaagacacggttctggagccagcagctttattggtagcatcctgactcaataggcagctttcctgataatagcaggaacatcagcctccttggtggcccactcattgtgtggctctggaaatcattcctggatattccacctagtctgtttctttagctttcccaacaactctgtgagccatgtaacattctgtaataaatttctttctgcttaaattagt

SEQ ID NO: 5960 - DNA, 216 bp, Homo sapiens
ttatctggacctctaatctattacctcttcctttctagcagccctatgtattctttactttcctccctatccagctgagattttgtttcaatttagtttcttgccattaccctctcttttacatgccaatttcaagcacagctgcagaaaatcatataaccagatttgcaggaatttatgatcagcctggggcgaacggagcaagactccatctca

SEQ ID NO: 5961 - DNA, 318 bp, Homo sapiens
atcaggcacccctggacaccaaacctggattcactatttgccactttaatccttacaatggcaatgacagcatggattttgtaaattattataagaggtcaccaatgtacataagatacttggcaacagtggctgtccactaaattgtggctattacaaccatcagcacaaagtagcctccagcatatactgtaagactagttccctggaaggactgagatcaactttccaccatattcacagaaaggaccagcgccaaggcaacacttgcctggccacaggggctctgtcacaacgcagcaaggaaagttaccaggc

SEQ ID NO: 5962 - DNA, 446 bp, Homo sapiens
ttcctactgaagaggcattaggactagagcgtatttcttttgattatcaatgcgggtggtagtgaggtatcctcagctgtttggctggctctcttattatattagtatctttttactattatcttgcttctgtttcagccaaaatttggattttgtttctttgccacacccataggatcaggtacagttaacctgtttgagcctaataatcaagtattgtactgaaattccaaatagaattggaaaatgtacttttttgatgggctacctttcctctttcctgcctcatccaaacagtctccattagaaataataaaaaccctcataggattttaaagccaagttagcagccctgagtcaggacaggtgtttatttttaattcatactcagaaagcactgtttacccatttaccagacagagcaagaaaggacaaatagtatatat

SEQ ID NO: 5963 - DNA, 844 bp, Homo sapiens
aaaatcttgctaaaagtttgtcaattttcaatgaaacaaatttaggattgtgatacttgctattgtttcattgtctttagttcattgattttcagtcatatctttatcattttcttccctctattcaacttgcctatcgtggatacgtttttttttttttttttcccttctaatttcttgggttgtatgtttggctcattaattttcaactcctttatgtcaaaggcaggattttaagacaataaattttcctttaactgtaactatagctgcacctcacacatttttacaaatagtttcagttacaactcagtactagatattttttaatgtctgttatcatttatttcctgtttaattaatgatttacctaaaagcattttcaaaaacttattgccataaatgtattcagtctttttccttttctaatagcttgaaactagaagttgaataagatcttgcccagaaaaaaagcatgtttttaaatccccaaatttatagagttctttttgctttttaaaagattattgatttataacttaatagcattatggttgatgacttggtttatatgatatcagttctttgctatatgttgagatgtgttttgtggcctaaaatgtggtcaatttctgcaaacgtacaatgtgcacttaaacagaacatacattctttttttattaggtacggaaatccatatatgtcaatttatataagtggttccaatccttttaatgacatctcatatatagaaaattctaatatttgtacagcacagtagcataagttggagttgatttgaaaatgtcttgcagggcttactaaaatatttattgtacctttt

SEQ ID NO: 5964 - DNA, 790 bp, Homo sapiens
aaaatcttgctaaaagtttgtcaattttcaatgaaacaaatttaggattgtgatacttgctattgtttcattgtctttagttcattgattttcagtcatatctttatcattttcttccctctattcaacttgcctatcgtggatacgtttttttttttttttttcccttctaatttcttgggttgtatgtttggctcattaattttcaactcctttatgtcaaaggcaggattttaagacaataaattttcctttaactgtaactatagctgcacctcacacatttttacaaatagtttcagttacaactcagtactagatattttttaatgtctgttatcatttatttcctgtttaattaatgatttacctaaaagcattttcaaaaacttattgccataaatgtattcagtctttttccttttctaatagcttgaaactagaagttgaataagatcttgcccagaaaaaaagcatgtttttaaatccccaaatttatagagttctttttgcttttttgatatcagttctttgctatatgttgagatgtgttttgtggcctaaaatgtggtcaatttctgcaaacgtacaatgtgcacttaaacagaacatacattctttttttattaggtacggaaatccatatatgtcaatttatataagtggttccaatccttttaatgacatctcatatatagaaaattctaatatttgtacagcacagtagcataagttggagttgatttgaaaatgtcttgcagggcttactaaaatatttattgtacctttt

SEQ ID NO: 5965 - DNA, 586 bp, Homo sapiens
acattaaatgaggtcacagggttgggactctaatttaataggactggtgtccttatgagaagagaaagaggcaccaggcaccaggcatgtgagcccacagaggaaaggctatgatgtgaagacagagagaaggccatcacacacaagccatggagagaggcctccccagaaaccaaccccaccgacaccttgatctcggacttccaagcttcagaactgtgagaaaataaattcctattgtttaagccactcagtcagtggaattctgttatagcagccctaacagactaatacggaagtcaagtagacaagtctggtctctgtatttctattggaactggatttactctgctcctatgagttatctctatgggagtttgatataaattgttaaaaaattgaagcagataaacatgaaattgtagagcaatttaaccaggtgttgtaatggaaacatttcttcctgatgctggccccatgttgtgtttataagtggaaagtttcttcctctccaagtccacaggactcctttcctttctaagtactctacgtggctggccacatcattaaaatatgagttattttg

SEQ ID NO: 5966 - DNA, 435 bp, Homo sapiens
catcaggaccaaatatggaaggaaaaggcaagaaatgagccaatcatgacaaggcttccggactgagtaactgagaggatgaaacggccactgactaagactcaaactgtgggaggagctggtttatgggagactctcaggacttcgggtctggacaggctgtcttgagttacccatcagacactcaggcagaggagtggagcaggatacacaggccggcggctcagaggagaggtttgggctcacaatgtgaatctgggaggagccaccatgtgggtaggttgtacagacaaggaacaggctactatccccaggagacagcatgcagacaaaaaaagaaagggccatgagcagagtgctgaggcacactctgttcaagtcacggaggtaagaactgtggcaaaaactgagcagtcaggaagatgaaagtcagat

SEQ ID NO: 5967 - DNA, 444 bp, Homo sapiens
ctgctggctgacacaggcagagcccctgaccagtagtagcccctgaacacactacgtgtgggcgacgggcctagcaggtcacattccttctgaaccctctcttcttctcatttgattctcaggacaaccccacagagtaggaaacaggacaggcctggttcgattcaagttagtaaactttttatgcttacccagatgaatgagaagaggaggtaacatgtatattatctactttcaaaaacttaattacttaaactcttgaagaaggtggaagacttcaaaaaagaaattcttttgagaatttggaaaagtagatgcatttctcagaaatagttcactgaaaaaattgtgtatcagaaaagaaggatgaaaataaaaggaaatcagctagttattttgttgttaacagaataatctcaggctctttcacacctagtcatctgg

SEQ ID NO: 5968 - DNA, 671 bp, Homo sapiens
tttctctggctcactttgttatgttccctctagaatgaggctctggtaagaaacatccctgtttgctaccctagtagtggaaaaaccctagtcctggaaacccaagacacctgaattggttcttcccagctccccctcaagagagggagacacttttagcttgtattttggtttacgggttaaaagttttatattaggatcagaatgattgcatctggtttgaagactgaaatttctttggacagggtcttgctctgtcacccaggctggagtgcagtggtgtgatcacagctcaccgcagccttgacctcctggactcaagcaatcctctctcggcctcccagagtgctgggattacaggtgtgagccatacacctgggcctaagagttgaatttttaaaacctacttaaaattactgtctttgtaaaaccgtatgaaattagaaccagaagttgccttaaagatctagtctaatcagtctaatctcattttgtagggagaagatttgcttgtaatacctgtaggatatggcaaagtagaacatgtaaccctggccacattggctcgtatatgtgatcccagcactttgggaggccgaggcaggcggattgcttgagcccaggagtttgagaccagcctggccaacatggcaaaaccccatctctaaaaa

SEQ ID NO: 5969 - DNA, 162 bp, Homo sapiens
cttaggttacaaatttctggaggggaaagattgttacactatgtggagtgattaaacggatcttttaacagaagctgatgaactcattctaagcctgctgtttgcctgcacaaagtgtcatgtataagatggaacattaaacatgatggctgatgattaata

SEQ ID NO: 5970 - DNA, 690 bp, Homo sapiens
tcacacgatctgggcttgtgaagttgactggcaaggttgggggtatttggtggccagcgtgggacatttgtggtagaagggactgaaagggattcatggaagctagattttaggagtgacagaaagggatttccctccgacctcctaggagctgtctcttcatctccggagttgttactgcctagttttttttcttggaaaaatgtccatgaattccagtgggtgtttcacaatgtgagagaaagtcttccagagcgagtgaacactgatttaacttgaaaaacaacaagaaaaaagtcacaggcacaccttcgttgagtggttggttcctgtaacaattttaattgttgaataagttgtgattttatttttgatttcaaacacgtgtatggaaaacctccttaattctgacctgcaagaaaagttttgaagcaatttggcctaccaaatgaatacctgtaaaaggaacagagcttggaatgatctgtcagagggagagttttgcaggatggggaggaggggatttggaaaattggattacttggtgagtgagtggtttatgaaattaagttacttaactgacaggattaccaggattaccattttgactgttttgggaaatagagtaggcctaaattgaaggtagttttggcctgttacttgaactgcttaaatggattgaggatggag

SEQ ID NO: 5971 - DNA, 447 bp, Homo sapiens
cctaaatctcaaacacattttatagtcttgaatggtttcagactttattcagtcatatttgtcacccatatctgcaatatctccagcttaattttatcagacttgacaagtacctaataattccaaaggtcaaaaagtgattcattggaatactgaaagaaaacacagcttaaactctagtaatttgatttatttgcttaatgtgcaaaagcctcattgacccaggatgcagttaaattgacgtcttggcccagaaagctttgaagcctaggaggtaggcaaagggagttttttctctcactcctcggcaaaccttcaaatttgatgttatttatctgttatttcctgactgcccattccacagagagtgtcagattgaggctcagacctgagcctgaaccctgatcctgtcacatgtgtgtttagcatcagcttgtaaatttctgc

SEQ ID NO: 5972 - DNA, 493 bp, Homo sapiens
cctagtagagcctcaaagaaaaggtctttgttattaaaagaaattttagaggataatcacttcttaaaaagtccctctgtcaaaagtcagctgcaagagggcaagatacaaatccttccagcccttggtgacttactggaataaacactttaaatcagcagctaattaccaggaagttttaaatctactgttggtggatgtttaaattggtgtaagttgagcatggtggctcatgcctgtaatcccagtacttttggaggctcaggtgagtggatcacttgagcccaagagttcaagaccagcctggtcaacatgttgaaatcccatctctacaaaataaaacacaaaaaattagctgtgcatagaggcacttacctatagtcccagctactcaggaggctgattgaggtgggaggatcacctgagctcaggagtttgtggctatagtgagttgtgatcaccactacactccagcctgggagacatagtgaga

SEQ ID NO: 5973 - DNA, 522 bp, Homo sapiens
gctggtcccgagtggtagcaggagagagatgggtgggtttcagacgtattttcaaggtaggaccaacagggtttgctgatagattgaagtgtcaagaaaaaaatcaaggatgtctctgaggttttcagcttgagcaactacaaagatggatttgccattttctgagaaggaaactacaggaaaatgaggtccgggtgggagatgaggagaaattaagaagtcgggatttgtttggggactgagaaatttgaaatgtctctgacatctgtgatggatttaattgtgtccccccaaaaagatgttgaagtcctaacccccagtacctccgaaggtgaccttatttggaaacagagtctttagggagataatcaatttaaaatgaggcaattagggtagaccctaatccaatattttataaggacaagaacagaaaaccagacaccgcaggttctcactcataagtgggagtcgaacaatgagaacacatggacacagggaggcgaacaacacacaccagggcct

SEQ ID NO: 5974 - DNA, 291 bp, Homo sapiens
tactaaaaataaattcacggccgcgtcgacctggtggctggcagccatccctggcgttctttgtagctgcatcgcttcaatctgtcttcctcttcacatggcctttgatatggtttggctctgtgtccctgcccaaatccccagtgttggaagagggaccagtgggaggcgactggatcatggaagtgcatttcccacttggtgccattctcgtgacagtgagtgaggtcttatgagatctggttgttttaaaagtgtgcagcctgggccacagagcgagactccgtctca

SEQ ID NO: 5975 - DNA, 385 bp, Homo sapiens
acaaaacaacagaaatgtattctctcacagttctggaggcagacatccaaaatcaaggtgttggttgggccaaactccctttgaaggctctaggggagagtcctttctagcctcttcctagttcctggtggctggcagccatccctggcgttctttgtagctgcatcgcttcaatctgtcttcctcttcacatggcctttgatatggtttggctctgtgtccctgcccaaatccccagtgttggaagagggaccagtgggaggcgactggatcatggaagtgcatttcccacttggtgccattctcgtgacagtgagtgaggtcttatgagatctggttgttttaaaagtgtgcagcctgggccacagagcgagactccgtctca

SEQ ID NO: 5976 - DNA, 460 bp, Homo sapiens
tacacgggaaaagtttcatgctcatgttacaactgtagtgacccacagtttttcagggagtataagaaaaagataacacccagtgtcaggcccttataaagcctcaactttcagaatcctttcacaatgttagatttgctgatcaatgaatatataactgaacattaagagtaataatggggctgggtacggtggcccatacctgtaatcccagcacttttagaggccaaggcaggaggatcacttgagcccaggagtttgagaccagcctgggccacatggtgaaaccccgtctctataaaaaatacaaaaattagccgggtgtggtggtgtattgccagttacttgggaggctgaggtgggaggatcagctgagcccagaagtttgaggatgcagtgagctatgattgtgccactgcaccattccagcctgggtgacagagtgagaccctgtctcaaa

SEQ ID NO: 5977 - DNA, 247 bp, Homo sapiens
gtgtgagggctgaagctaaacttgaacctggagactgaggccccaccctagcttggggacaggcatcactgctgaagtggactttccacgggagctgcccaggattgggctgcccttaagccaaggcattcctgtggggaaaggagacttgtgtgtgaccaagccctcctcccctctcttactcctgggcttacctgggatggaagctcaccttctcctggagatcctccgtagggcaacaagcagg

SEQ ID NO: 5978 - DNA, 360 bp, Homo sapiens
acctgaaagccaaagtcagagagaatgtttgggacagactgcctgtaccaaaaaaagtctgaactcaggcagctctggctagagcagtgccctttaggtttctctaggaaggtcactggtaataggaagcttgattttgtgagaggagagagctgcctgtctgtccaggccatggacctttccttctagggttggtctcaatccaaaaccagccattccttggtctgccattttatgaatgctgcagtggttcaggatacagctccacaagctgaatttttttttttccatttgtagttggtacttgaaacaaatacatcactaatagtattagttgattttaagaactgttgattcctt

SEQ ID NO: 5979 - DNA, 498 bp, Homo sapiens
gcagacttcacataatggtaggcattaaaataaatggagatacaaacagaaaacagagaagcagaaacagaaacacctagagagtaggagatgcccatttaataacctattcatttataatcttattaaacatctggcaaaaatcataaggacatggcatgtggcaattgtggacataatgtcagcacttggtacttgctatttcaacctatgtattcatgtatttaaggattataacaaagcattttcacagattagaaaagttaattttcatttcagctccatgagatcaatattatttgccttgtcttgcggctggaggctgagcaaagacctgaatgccagtcaacctgcccccaagctcatgcttttagcatcacaggggacacacgggaatattactgaaaagccttcagcaaaaaaagcacaaaaggaaactacagcagcctttcattcgcgggatccctaccccagagagtccagactgggcactgcgca

SEQ ID NO: 5980 - DNA, 583 bp, Homo sapiens
  misc_feature (30)..(30): n is a, c, g, or t
  misc_feature (46)..(46): n is a, c, g, or t
  misc_feature (72)..(72): n is a, c, g, or t
  misc_feature (85)..(85): n is a, c, g, or t
ggaaccagcttggcctggattccggaaagnccttcgactcactatngggaattttgcccctcggaggcccangaattcggcacgngggctcacattgtaatcccaacacttcgagagttcaagaccagcctgagcaatatagtgagacctcatctctacaaaaaaaagtttaaaaattagctgagcatagaggtatgcatcttagtcccacctacttgggaggctggggtgggaggatcacttgagcccaggagacagaatttgctgtgagccaagatcattgccactgcattccagcctgggtaacacagtaagaccctttctcaaaacaaaacaaaatatcatatatgcattaatttacttgcatggtgaagtccaacatgtcaaaaatgaaatgatgagctgtattgtccctatgtctacccagtctactactttgtgttttaaggttcataagactttttgagtgctatgtgtcagtagtctatttacagagttcatccaaagaatttattgaattaaaggatggttctaatggaaatctattgtgttttgttattacatgcacacctaaaaaaaaaaa

SEQ ID NO: 5981 - DNA, 1062 bp, Homo sapiens
tcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaattctatacacagtgttctgaagcttgctttcttatatagtattttggagattattccaaattcatacattgggtcagagtaattctttaaaagttccttgcatataacagtgattcaaaaagtatatggatgaatgagtgaatgctgcatgaatgaatgaatctgattcaattggtagctacagctgttctctcagggtctgatctgaccaagacagcaccttctagattctagaatgtgtcctcctgactaaggggttcaggatactgttcaccttctccaacagatgccaccggagccttaggaactgggcacaggaagccttgggcccctggaggaaaaagttgagactaggacgcaggtcccaagtatgggatttttttgggttcctacttaaaatgcttttttctttattggaaaatgatgtaacattttagagaaattaaaaagcacacatatttata

SEQ ID NO: 5982 - DNA, 600 bp, Homo sapiens
tcatcagaaaatgcttgctgtaacaagcgtttatctgcacattatgctgcagtgaatgctctactgatcaagttaaacagataagatcccttcccttgtagaaactacaacttaatacagtctaagacttgacaaattacttagtatttattttccaactgctttatctctgtaaaatgatatgctgaattattataagctaattgttgtagaaagaactttccccttaacttatgtaaacagtctggttttaaaaaatttgataattgtggcccagtaagctcaacactttgccttccccaagactggggaacctctgtcctgttcaccactgtatattcagcaccaggcagtttctttttttgtttgtttgtttttttgttttgaaaaattaatacatatacatggtaagacattccacaatacaaaagggtatacaataaatggtaagcttccccatggaggtcagcctctagtcccctctccagagttaatcactgttatctatatgttgtgtatcctttcatagcaattctatgcatttacaagtttataaatatgtatatttatatatctatttttaatacaaatagtagaatt

SEQ ID NO: 5983 - DNA, 307 bp, Homo sapiens
cagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaatgtaggtgtcctgggcaggggctgtatctgaggcacacatccttggtagtgactggctagcaggaggaagtctggcagttagtctgtcaggcctggttggtcccatgggaggcctgaggtgccatcttagaaatagggccttgttaggag

SEQ ID NO: 5984 - DNA, 1838 bp, Homo sapiens
gaattttgtggggacacagatagtgagattatagtggttgttcatctcttccctgccatgccatgcacacacgtggcaccttgggtttgtctggggggagaatgatgttcccgttatcccgatggtgtccagcttttgtatttgtcatgtcagctgctgggcctgtcttagaagttgctaataacttccactttaatattactcttattgatgcattgggtttttttattgaccaataaataatttaggcattggcaatgttaagaccataacataaaccttttctaagtaatttttccatattgagcttattagcatcttttggtatctgctgggtttttagctttacaacaggcactcacatataaacatgtttatcctatttagatttgtagttcctgggagtcagagttctgtgagcagtcttaacttataaagcatgttcagacatgcttttcagatgattttgtttcattttaaaaggggaaatggcattaacctaataggaattctcctcctgaacctcagaggcagcagatggtacagctctctttgaactttactgcccaggtgaacgttctctgcatttagatcttcaggagttttacagactagtgtggagtggacatgtaaggacaagaggaagaggcaggtttcagctgagctcttctcctccttagagcaggacagtgttgggatgggctgattgtgagtatggagttctttctggaggagctccagcaggagctgggcaaatactgggagctttgactaaggggcatgcattgcagatgaggtttgaccagaggttttccaggatccctgaagaactctgcacttctaagcctgtaaggccacaacaggtgagatgaagggggagttgaacttccagctccttgtgtgtcccctagggttccccttttgggtccacacaaaggctcttgagcccaatctgaaggtctaaggctatggatatctcctccatttctaagttgggacaaggttgtccagcaaaaagaaaagcaaagactggtccaatcttagagacgtttgttttggaagcagagctgggctattagctttcctcaagaaggaaaaaggagtgctacaaagttaaatactgatttttaaaaaaaattggcattcacacaatttctactaccacagatgagacttctttttgtttttctcaaaaacttaggctctccgagggattggtggaggctgtggtacagtgagggagcagagttctctgccacgttggaaatcagcctcagacaggagcaggccttgggttccctatggtggtggaggcgagctgagagatgttgaggcagtgagagcgattgatagactgctacccagcattggagagatgactctctagatgtcctgggctggcattctagcttctgacatgccagtcaaacccatagattcacacgcctgaagggaccatcagtggtaagatttatcctcctgacttcagacaaagccacatccaagccatctcaggcatttaaggatctatcctatttttgaagtctccaaaaaggatcccttggtctctcagtttaatgtcataaactctgtaagtcaggaaatttaactttagagcaagctcagattctttctatggttcaaagaccattttctttggcaatcatcctctctctgagtacccttcatgtatttgaaaaccaatactaaattggctttcagctgtctcttctccccaggtggaataatttcagttctagtcacttgaattcagaagaaaaagcatgctagcaaaattcaaatcaagtaaatataagccttttttagggaaaaaaaaa

SEQ ID NO: 5985 - DNA, 566 bp, Homo sapiens
ttttctttgagatggagcccaaactgtagtgtacagtggtgcgatcctggctcactgcaacctccacctcccgggttcaagcaatcctccaacctcagcctcccgagtagctaggattacaggtgtgcaccaccaggcccggctaattttttttgtattttagaggcggggtttcaccatgttggccaggctggtctcaaactcctgaccttaagtgattcgcccacctcagcctcccaaagtgctgggattacaggcatgagccaccacctataaccaaattttctacatgttacttttcccaagaacttgccaaaagaattaaataaatcatccactgtttttttttttttttgagacggagtcttgctctgtcacccaggctgtagggcagtggtgcgatctcggctcactgcaagctccgcctcccgggttcacgccattctcctgcctcagcttcccaagtagctgggactacaggtgcctgccaccacgcctggctaatttttttgtatttttagtacagatggggtttcaccatgttagccaggatggtctcaacctcc

SEQ ID NO: 5986 - DNA, 383 bp, Homo sapiens
tggaagtgtagatggaagaatgataagtatgccatgatcctggcctttaataagttagaggtattaacacataaagacttcagaagcagtagtgtgtgaggagtattacctcctctgatcctgttggactgtcctgaaaccaaggttgacgggccattataaatccatactatctgacctcagtgaggttctccctgctgtcttctcagtcactaattcttcctgtatactgttgggatcctatttgtctcattctttccagtcccaccactgtttaggttttcttacaacagactttagtctcaatttttctagtccagcagtccccaacctttttgacatcagggaccagttttgtggaagacagttttccacagacagag

SEQ ID NO: 5987 - DNA, 358 bp, Homo sapiens
gttggttttctgcataatgtatgtatttatgcagtatgtgtaccgtcctgtgacctacactggttggtgttagttacaagggcccttggatgggtttaggagatggatgtaccctctcctgagggctgtgaatctgcagtgggaacaatgtcagacacagtcctctgaagatggaaaaaagctcagaggtcaaaaaacatacccctagcccatcaccattttttcccctttaacctctaagtgaaaaattgcacacaattttctttacgtatactttctaaaatcttgtgtctccttcaacacttcctttgatatatgtgggagatcaagatgaagaaaaggagaaatgggaatggcg

SEQ ID NO: 5988 - DNA, 348 bp, Homo sapiens
gtatggttatgccattttgtcttcaaatatacaattatgttaatgaagagaatgatcttgttaatctttttaacagattgccttttgctttctatttattgaggtaatttttcatgctgccagttcaaaactgtacaactttaaatgattcctttttcacatcttattcaggaatttaatttgcatatattttaggtgccaattaggaggttgatttatttattgaaatagaaattacgggaggctgacgcaggagaatcgctgtaacccgggaggcagaggttgcagtgagccaagattgcgccattgcattccagcctggcgacagagcaagactctgtctcaaaa

SEQ ID NO: 5989 - DNA, 622 bp, Homo sapiens
ccactttcaaactgttaattttaatattaacatatgaaaaataatcacggcaatgaagtcatttactacttattcctgatagctaagcatgaataatatatgcagaaaaacatttcatttcctaaattatggtcaaatatattatgaaggaaaaattttctggtaaagaggatggaatagtaagggctaattgcagcagaaagacactgattgagttggctgctgagaaatgaggacaggtgcaatggcttgcgcctgtaatcctagcactttgggaggctgaagcaggacagcttaagcccagtctgggcaacataaggagacacctgtctccactaaaaaaaaaaaaaaaaccaatagctggccatggtggcgtttgcttgtggtccccgctgcttcacaggctgaggcagaggaggactgcttgagcctaggaggttgaggctgcagtgagtggtgatcaagccactgctgcactctaacctgggtgacagatcgagacctcatcccaaaaagcaaacaaacaagaaatgaagaaaatcctgtgtcagatgaaagagttcaggctttacccttgctaaaacatggacagtttttcttctcaagccatgactttgtttgt

SEQ ID NO: 5990 - DNA, 483 bp, Homo sapiens
aaaactgcttgtcattaataagggacaggcccccaaactggcacagcatagcttccataatactgtttgtcattatagtcagagcataccttcagatttaaggggagaggtgtaactctctgtggaaagactattgttcaccttttggccacagatagcttacatttctcccatctttgaaaatctcatgccagcagggcacagtggctcaagcctgtaattccagcattttgggaggctgaggcagatggatcacttgaggtcagaccagcctggccaaaatggtgaaactccatctttattaaaaatacaaaaattagctgggtgtggtgactcatgcctgttattacagctacttgggaggctgagatgagagaactgcttgaactcgggaggtggaggttgcagtgagccaagatcattgtgccactgcactccagcctgggtgacggagtaagtgagactctgtctcaaaaaaaaaaa

SEQ ID NO: 5991 - DNA, 443 bp, Homo sapiens
gttggttgttttcagaatcataattagaggtttaatagcctattagaataaccaatggcatatacctcagaaccctgcaagtgtgctcatttgactatgctccaccctggcattagttagtattagtgcctagctgtgcctctcaactaaccttgcagtgagcactgccaaacctagccactattgcattcaacaaatgtacctccatcagtgcagtggcgtgatcatggctcactgcagcctcaaattgccagactggcctcaagtgatcctcccaccttggcctcccaaattgctggaattacaggcgtgagtcacaatgctggccttttcactttcttttctaagactctttttcattaggacaaattcacacctcactttttcttttctgctctaagctgtatcacttgaaataaaaaatggtaagtaatttgtcgaaa

SEQ ID NO: 5992 - DNA, 201 bp, Homo sapiens
gctggttgtcgaagccttacttatgctaaaaaatagaactaacctaaatatccaatggggattgtttaaatgaattatgattcaaccttccacagagattagaatcatgctcttgaagaacactgatgatgtaaaaagtctgctaacatattaagtgagaaagcacattacaaaatggaatatatgttctgataatttttg

SEQ ID NO: 5993 - DNA, 738 bp, Homo sapiens
ccggacggttcccccttgtgtggccctggccggggtgttcccgggccccctttggaggcctgcccttgtaggtgtgtccagtcggtgtcaattgcggcattcgcttccttgggcgcctttggagcgttcgtgggctttgtttacccgtggcaggggatttctcaggcgttaattgggtcccccggtttccagtcccacgttttaaacggggccagtaattgtaacggaccccctataggccgaattgggtacccggcccccccctcgaaggtcgacttggtttccgtgatgagttcttggcttctggggttggttgggagtcccagatccagggaacagttgagatggtccagcgttccttcattctttctaccgacaaggcctcctggggccagatggatagaggagccacaatgaattcatctccatagcaactcaagcttcctcctccatcatctggaccagtgcgtcccagtggcaacttcttgacatgagtcgattctaccttcaaatgactgactcatgccaaatgtcctggccacagaatgggcctgtgacccagtcctggtcaacgagtctgctcaggttgaggtgggaggcttttttatttttatatttttgtagaaacagggtcttgctatgttactcaggctggtcttggactcctcggcttaagcaatcctcctgccacagcctcccaaagtgctgggattacaggtgtgagccactgtgctcaga

SEQ ID NO: 5994 - DNA, 1224 bp, Homo sapiens
caccaggagggtcggagggcattcttcgatcccaaagataatagggctgaggccaaggagaccgttgcagtccccctggccaccttctgggtcatccagggacctcctcatggcagtttgcctctctgggtccaagggcaagctgtaagtggtctctgaggtcctggagccacagcttgggaaggtgttgatgggcagggtggattctgagggcttccctctggagaggaagcatgtgatgagaggtgtagacagggtcaggctgggacagaaggaaggaaaggggcagagctggggggagggggaggaagcgatcatatggggagtgtctggcaagagtagactggccagtctagggagtgcagcggggagaggggaaagggagaaagtacagaagacagatgaaggagaggaggtaagcgagaaaaaatggaaaggggagccggaaatggaggagagaggacaagcaaagagacagaaatgaagacatgaggaaaagctgggggaagcaggagaggaagggacgggatgtaggagggggaagaaaaatcggagatgagacaaaagaaatgtgtgggagacgggtagagacgaaatgcaaggggcgtggttttggtttttctccaagacctggagacatcgacccccatcgccttctgaagagagagggagggcgggcactgggggtcaggagagtctccagcaggggaggggaattgtttggactattgttcttcaggattggaataaaacaatcttattttggtttccgtgatgagttcttggcttctggggttggttgggagtcccagatccagggaacagttgagatggtccagcgttccttcattctttctaccgacaaggcctcctggggccagatggatagaggagccacaatgaattcatctccatagcaactcaagcttcctcctccatcatctggaccagtgcgtcccagtggcaacttcttgacatgagtcgattctaccttcaaatgactgactcatgccaaatgtcctggccacagaatgggcctgtgacccagtcctggtcaacgagtctgctcaggttgaggtgggaggcttttttatttttatatttttgtagaaacagggtcttgctatgttactcaggctggtcttggactcctcggcttaagcaatcctcctgccacagcctcccaaagtgctgggattacaggtgtgagccactgtgctcaga

SEQ ID NO: 5995 - DNA, 347 bp, Homo sapiens
ctgtgggtgtgcttctgcaggctttaataccagcacaactgtatttctgcatggcaggactcaatattttaattgtgtggacttaaattctagcatccagaaaaaggcagccttctagggaggtgaggaggatgatgagagcacgtggaagcttttcttcagtgctaaacatgttactctaaactcacaccaggtgacccaatgatgaagttcccacagatttaccaaaggtaggaagaaagtcccagaaagaaatgcttagatgaaggagaatgatattgtcaaagcaagcaccagccagagttcaataatttatgtcttacaaaacttattaaatatcagggttt

SEQ ID NO: 5996 - DNA, 2077 bp, Homo sapiens
aatctaagtttcacaggctcagggatgaacccaagctaccaaatgcacaggcccctcctgtatacggttacagcaggtaagggagtaacttactcagtgcaagctgctgtaacaaaatagcacaagctgggtggctaatcaacaacaggcatttatttctcacaggtctggaggctggaagcccaagatcagggtgccagtgctggcatggtcgggttctggtgagggccctcttccaggtcacagacagctgtcttctcattgcatcctcacatgacagaaaagaagtgcacaagctctctggccccctcttacaggcgctaatcccattcacaagggtcctaccgtcatgacctcattacctcccaaagaccccacctccaaataccaccacattgccattaagcttcaacatatgaatttaagggggaaacaaacatccagtccattgcagattgtcctgataatatgtgtgcccagggcattgcccccacagcaaagagagacattggaaggcaaaccaatgtcaggtttcctaatgtgcacggagtcatccctggaagagtgagtccggtgatcttaccagctaattgcattgagctaccccaccttggggatctacctgccaaggagaacagaacaccactggctttgacacccatctctcaacaatgatggaagaatgctggaaatttacctgctctggtagctctgtctaagttcatcttccttgtatggactttctttttttattgctctcaaatacttgtattattaaatatctcatttaaaatttctttaaaatacatttaaaagtacatttaaaagagtacattttaagagtgcagatgaaaacataatgaatacatctttgcttaagaaaaaatatttcggacacagcatgaactcagttgctggttccaagcccctccccttctcactacactgaacttggcatgcattctttcttcaggtgtgtttgtaatcttactacatatggacatatcccccagcaatatcagggattgttttgcttgttcctagacatcatataaatggtatcataccaattatacccctacactacttaatgtttcattcaacattgttttgggggactatccatgttgatacatgaattctgttgtgttcattttttcctcttgtgaaatagtccatcatggaaattgtccctagtgtgtctatctgcactcctaattgacaggcatttaggctgttttccattttcctaattacaagttatgctgagtgaacattcctgaacataggtgtgaggctgtctctggagcacatgccaaggaacagaattcttaggtcgtaaggaatgtgtacctccagccttagtcaatattgccaattgctgtcctatctgattttattcatttacgctcccactagcagtatatatgagtctttctttcacttcttgccaactcttaccaatctaatgaatgggaagtggtaactcattattatttcaatttgtattccctgtattaatccctgagaccttaacacttgtgtattgcacattctggttcctctttggcaaattgccttggcattaagatagtaaattttccttgccacctacgctggttgagtcaggatgcttaattacttggaggtaaaaagcacctagctgaaatagcccatccctgaggctgccctgttgaggataggagatgcttcatccatctttagatcctttcttggaaacgctgagcctggccagccatgcaggcttttccaagctctgatgctgccctgtgtccacaatagcatccccacagcctggatccatcattcccagcattatgatagctcctttgtctccttggaagagcccaaaacccacagctgaggcctcagggcttttctaatgtgcttagaacaggggtaaaggtaatgccaaccaaaatggggaaacctgtattcttgctcagtcactgcttagtcagcataaatcactccagaggatagtttgttactgacctcaaagactcagttacaaagatgatcaccatagcattgtttacagtagcaccaaaaaaaa

SEQ ID NO: 5997 - DNA, 468 bp, Homo sapiens
agataggctggacaaagggatgattcacatccccagcaggacggagcagcaggatagtgggagacttttatcacactactcagaatagtgtacaatttaaaacttaggaattattatttctggacttttccatttaatattttcagactgcagttgaccaccaataactgaaaccttagaaagcaaaacctcaaataagggggaactactgtacctaacacagaatcctttcttggtacataggatttacagtgaaattaatccctaaagatctagtccttagtttttctgtgctaagcagttaaagaagatatttcctgccattgtgccttcagaacagtgaatttggctgggaacagtggcccacacctgtaaccccagcacttttacgagaccgagacaggttgattgcttaaagctcagtagtttgagaccaccctgggcaacatggtgaaacctggtctctat

SEQ ID NO: 5998 - DNA, 317 bp, Homo sapiens
tgatccgcctgcctcggccttacaaagtgctgggattacaggcgtgagccaccgcacccggccctcccctctctgaacaggattgcctactctgtcctccgactcccagagcttttcactgacacctggggactgctgggtccctccttctctcctagcctgcccagggccaccccaagcctgcagtagattttcatttatctctgtaagaacgtttacaaggacatggagcaaattagcatcacacaaatgacgatgctgcaaatgagcggtgtacagggttggcgggtgttgcaggcaggtttcctgtcgttggc

SEQ ID NO: 5999 - DNA, 434 bp, Homo sapiens
ttgttaagtccaatggacttttctccctaatgtatttttttccagtcttacttgactccccagcagtatttgacgagttagccatgtcatcattcttaagatactctcttctgaaattttgtgatgctttgctgtcttttggccttttcttagctctgactctccagtctcattttccactttggctccactccctctgcccattccttaaatgttagggttccttacatttctgttcttattcctctggtcactcaatacattctggtgatatcccctagagtcatggcttcacctgtaatcaccatctatatgttaaaggctcccaacctttataccctgagcctacctcactactaagctttagacctgcaaatacactgatatattgactgttacttgggtgttccacccaacagatccctcaatttaaa

SEQ ID NO: 6000 - DNA, 309 bp, Homo sapiens
agaaagtggtacttggggcaccttgcttcatgtaaggtggctttcggattcccagatacttgcagttatcaggacccatctcttcacgattggtccttgaaaactgaagccccttgttttctgagattagaaaccgtcccttcccaagaacagctgtagcattaactcacgcctaattggtttttagtttccccttcgctttgggcctagaagggttttctttactttaatgtgaacttagctgtgaaataaaaaaagtatcactgtcatgttttaaccagatagattctattgcagaagcccctgttg

SEQ ID NO: 6001 - DNA, 450 bp, Homo sapiens
caagagtttgaatggatatcttcaaggggatgcattttattggagacatttattgcctggggctttctgttttcagtctgactccccagctttctgtatcattgttttaacatacatccccttttctcctttattggaagagaagctataattctcctcatttcatgataatccttttcagtctgttttgctcaaaggacaaattcttttcaacaactattgtaattattttcttagagggccatttttaattgccgtattgtttagctaagccctattgtcttggtgtccttcaaaactgtcagttgcattaaaatataggggtgggaggggagctgataagcacattgttgtaattgatttgtatgtttgaattgtcttatcagaaaacaaggttatgaatttcatctgttgagacacaaaaataaaatactttcttaaaaaaaagca

SEQ ID NO: 6002 - DNA, 455 bp, Homo sapiens
attctacttcataagtcgacctttctaagggataagatgttctccgttttccagatactagttctagatcttgactcagacatatgtttgacatgaagactagtctgtcagtcttcaagaatactgacttgttttgttttggttttattaatatattcactagtctctggctgggcacggtggctcacacctgtaatcccagcactttgggaggctaaggcaggcggatcacctgaggtcaggcgttcaagaccagcctggccaacatggtgaaaccctgtctctactaaaaatacaaaaattagccgggtgagtatggtggcttgtgcctgtagtgccagctactcgggaggctgaggcgggagaatctcttgagcccaggagacgcaggttgcagtgagctgagatcgcgccactgcactccagcctgggcgacagagcgagactccatctca

SEQ ID NO: 6003 - DNA, 1569 bp, Homo sapiens
cgggcaggcccagccttgtagtctgcaaagaccatgcaagccttggttgataaaccgggattctactggaagtttgcactttccccacatcagccaagatgggtaaactgccttaacacaaaagtcacatgccccacaaaatatttccttctatctcaaaacagtattagcttctttaatctaagaaggtaatgagaggtttttaaaactgagttaagtcagcagttcagcaagtgcttacgaaagacagtcaaaatataggcaagttactttaaatgggtattatttgtccttactttcccaatgtaggcaagtgcctgtgatataacaatttagggaataatgggagaataaaaagcatattagtttcaatcagatttcctggcatatatcacagaccctaaggaattacaaagacaaaaaagcaagctctttggtttctgcatggttctttgcagactacaaggctgcccctgcaagcacttggatgaaaagaccgggattctactggaagtttgcactttccccacatcagccaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttaaaaac

SEQ ID NO: 6004 - DNA, 960 bp, Homo sapiens
tcactgcactctagcctgggcgacagagcgagactccatctcagaaaaaaaaaaaaaggcggggggagcgcagggaggcaaggaggaagttttgggtgccgcctgaggctctgttgagtgttagtgttctctgctttggaagaggaaccacggaagtcttctttcagagaaacagtgactattggggagagatttaaaagagggaagtggttatgagggagtgcctcagggaaccacctttcctggccaggcacctaagaggttcctcccagcttttcctagcagagttgctcagactggatgggagctgagagaagacaaaggagctagaggggggccggggattctggagggggtaagacagggggaaaagctgggagctttggagccagacagtcccgagttcaagtcctgccgctgcttcaaccagccgagtaaccctgcgcaaacaacctggccccttggtgttgctcgtggggcctgataaaattcaactcttagttgctctgagactcccatggcattatatctccaaaggtgccaggcatggtgctgggcaccaaggtgctttccatcccttccctgctaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttaaaaac

SEQ ID NO: 6005 - DNA, 1064 bp, Homo sapiens
taatctggcatccttcccctggtgggcccagcaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttaaaaac

SEQ ID NO: 6006 - DNA, 1536 bp, Homo sapiens
cgggcaggcccagccttgtagtctgcaaagaccatgcaagccttggttgataaaccgggattctactggaagtttgcactttccccacatcagccaagatgggtaaactgccttaacacaaaagtcacatgccccacaaaatatttccttctatctcaaaacagtattagcttctttaatctaagaaggtaatgagaggtttttaaaactgagttaagtcagcagttcagcaagtgcttacgaaagacagtcaaaatataggcaagttactttaaatgggtattatttgtccttactttcccaatgtaggcaagtgcctgtgatataacaatttagggaataatgggagaataaaaagcatattagtttcaatcagatttcctggcatatatcacagaccctaaggaattacaaagacaaaaaagcaagctctttggtttctgcatggttctttgcagactacaaggctgcccctgcaagcacttggatgaaaagaccgggattctactggaagtttgcactttccccacatcagccaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttaaaaac

SEQ ID NO: 6007 - DNA, 1793 bp, Homo sapiens
cgggcaggcccagccttgtagtctgcaaagaccatgcaagccttggttgataaaccgggattctactggaagtttgcactttccccacatcagccaagatgggtaaactgccttaacacaaaagtcacatgccccacaaaatatttccttctatctcaaaacagtattagcttctttaatctaagaaggtaatgagaggtttttaaaactgagttaagtcagcagttcagcaagtgcttacgaaagacagtcaaaatataggcaagttactttaaatgggtattatttgtccttactttcccaatgtaggcaagtgcctgtgatataacaatttagggaataatgggagaataaaaagcatattagtttcaatcagatttcctggcatatatcacagaccctaaggaattacaaagacaaaaaagcaagctctttggtttctgcatggttctttgcagactacaaggctgcccctgcaagcacttggatgaaaagaccgggattctactggaagtttgcactttccccacatcagccaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaagggccacctggaccaccaggcaagatgggccccaagggtgagccaggagatccagtgaacctgctccggtgccaggaaggtgaggcagcccttgcaggagccaggaacttgggatcacatggtgttgggtgttggcagacccccaagtgtggccaagatcctccccacagcctcctcagaacccttcttcagggacctgaaggagccaagagggtccctagggtcccacacttgttccagtgcctgggggtgggggtcagggaataacctgggcaccaccccagtccatctcccctttcccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttaaaaac

SEQ ID NO: 6008 - DNA, 1760 bp, Homo sapiens
cgggcaggcccagccttgtagtctgcaaagaccatgcaagccttggttgataaaccgggattctactggaagtttgcactttccccacatcagccaagatgggtaaactgccttaacacaaaagtcacatgccccacaaaatatttccttctatctcaaaacagtattagcttctttaatctaagaaggtaatgagaggtttttaaaactgagttaagtcagcagttcagcaagtgcttacgaaagacagtcaaaatataggcaagttactttaaatgggtattatttgtccttactttcccaatgtaggcaagtgcctgtgatataacaatttagggaataatgggagaataaaaagcatattagtttcaatcagatttcctggcatatatcacagaccctaaggaattacaaagacaaaaaagcaagctctttggtttctgcatggttctttgcagactacaaggctgcccctgcaagcacttggatgaaaagaccgggattctactggaagtttgcactttccccacatcagccaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaaggccacctggaccaccaggcaagatgggccccaagggtgagccaggagatccagtgaacctgctccggtgccaggaaggtgaggcagcccttgcaggagccaggaacttgggatcacatggtgttgggtgttggcagacccccaagtgtggccaagatcctccccacagcctcctcagaacccttcttcagggacctgaaggagccaagagggtccctagggtcccacacttgttccagtgcctgggggtgggggtcagggaataacctgggcaccaccccagtccatctcccctttcccaggccccagaaactgccgggagctgttgagccagggcgccaccttgagcggctggtaccatctgtgcctacctgagggcagggccctcccagtcttttgtgacatggacaccgaggggggcggctggctggtgtttcagaggcgccaggatggttctgtggatttcttccgctcttggtcctcctacagagcaggttttgggaaccaagagtctgaattctggctgggaaatgagaatttgcaccagcttactctccagggtaactgggagctgcgggtagagctggaagactttaatggtaaccgtactttcgcccactatgcgaccttccgcctcctcggtgaggtagaccactaccagctggcactgggcaagttctcagagggcactgcaggggattccctgagcctccacagtgggaggccctttaccacctatgacgctgaccacgattcaagcaacagcaactgtgcagtgattgtccacggtgcctggtggtatgcatcctgttaccgatcaaatctcaatggtcgctatgcagtgtctgaggctgccgcccacaaatatggcattgactgggcctcaggccgtggtgtgggccacccctaccgcagggttcggatgatgcttcgatagggcactctggcagccagtgcccttatctctcctgtacagcttccggatcgtcagccaccttgcctttgccaaccacctctgcttgcctgtccacatttaaaaataaaatcattttagccctttaaaaac

SEQ ID NO: 6009 - DNA, 1491 bp, Homo sapiens
cgggcaggcccagccttgtagtctgcaaagaccatgcaagccttggttgataaaccgggattctactggaagtttgcactttccccacatcagccaagatgggtaaactgccttaacacaaaagtcacatgccccacaaaatatttccttctatctcaaaacagtattagcttctttaatctaagaaggtaatgagaggtttttaaaactgagttaagtcagcagttcagcaagtgcttacgaaagacagtcaaaatataggcaagttactttaaatgggtattatttgtccttactttcccaatgtaggcaagtgcctgtgatataacaatttagggaataatgggagaataaaaagcatattagtttcaatcagatttcctggcatatatcacagaccctaaggaattacaaagacaaaaaagcaagctctttggtttctgcatggttctttgcagactacaaggctgcccctgcaagcacttggatgaaaagaccgggattctactggaagtttgcactttccccacatcagccaagatggatctactgtggatcctgccctccctgtggcttctcctgcttggggggcctgcctgcctgaagacccaggaacaccccagctgcccaggacccagggaactggaagccagcaaagttgtcctcctgcccagttgtcccggagctccaggaagtcctggggagaagggagccccaggtcctcaaggtgagaggggctggggagcgggctgggatcttgggaatggggaaggcaggaaagtagcaatttttgtctgtgctgaggggccacgacaaaggagcaaggaacctactctgtgccagctccaggctgggcacccggcatcctaagatcaactctgccaggtaagtggtttcatccccattctgctgaggaggaaagggaggttcagagaggataagatatttgcccgcaatcacaaagtgagtgaagggtgaaactgggatttgaacctctggctccaagtctcttgtttctttttggtcctgggcatggggtgggactcaggaaatctctgcctttgtgatttcagggccacctggaccaccaggcaagatgggccccaagggtgagccaggtgagtaagtggggctggaggcctccccgctttctttgcctctgtccctggactctagggtgggatctctgcttggctgctgtgcctatgatggctctctcacaggggaatggatggctgggaggagtgggaaggattaggagaagggcctggctaccctatgatggccctcctattggggatggagggctgggaggagtggggaggattaggagaagggcctgggtaccctatgaaggccctcctacagggtttggaaggctgggaggagtggagaggattaggagaagggcctgggtaccctatgatggccctcctacagggtatggaaggctgggaggagtgggaaggattcggaaaagggcctgggtac

SEQ ID NO: 6010 - DNA, 424 bp, Homo sapiens
tgccccacccccaagaactgaggattcctccatccctgcctccccttctttccaggtaactgggagctgcgggtagagctggaagactttaatggtaaccgtactttcgcccactatgcgaccttccgcctcctcggtgaggtagaccactaccagctggcactgggcaagttctcagagggcactgcaggtgagtgagcctaaggggagcagaggaaggaggctggatcctttcccagtgctgccactgcccccatgaatgacccagggcaatcctgtctcctctgtgggccttagtttccgcatctgagaaatggcaatcatgaaacaggatggtgcaacagtgaagaatttgggatctggaggcaaacagacctgagtttgaatccatctctgccatttagtacttatgtgaccttgggca

SEQ ID NO: 6011 - DNA, 2378 bp, Homo sapiens
  misc_feature (1250)..(1250): n is a, c, g, or t
  misc_feature (1580)..(1580): n is a, c, g, or t
gcatccggcatttggcggggcttttgtctctcgctgcagccagagcttgggatcgctttctgctattcaacgtcctccacctctgcccccctctccccccagccggtgacaggctgttgccctgtgatctgcaggtcctgggacgtgcacagacagctaagatgccaggacattccagaaggtgggaaaggcacctgagtaatttgactctcctgcctggacccagcgtacagatgggattgtgcttcattgctggacccagcatttagggatcgtcactcccgtggatgatcaaagctactccgggggctgaggcaggagaatcgcttgaactcgggaagcagaagttgcagtgagccaaggtcgcaccactgcactccagcccaggcgacattgtgagactccatctcaaaaaaaaagaaaaaaagtgtactaacaagacccagcacacagaggagacttttaccattgtatgaacacccatcaaacagtacacatcatcattgtgagttctgaatctcacacatagaggaagtcaaaggtggaaaacttgactctcatatttggatccagtccacaggtgtgattttgacgcacacttctgcccagcacctgagtaatgtgattcttcagaattggcccggcccacaaataggattgtgccacactgctggacccagtgcctaagtgatgtaactctattcttctgccttggtgctactcgaaaaagacattgtaacatatctcagagccttacacccaggtaatgtgagtctcctcttctgccttgctgctgcacacagaagcggaatatgtacaggattgttaatctcatcttggatcttcctgcacttgtgattgtgacacatgcctctgtgtagaacctgagtgagtttactctcctgcctggatttaacccatagatggaatcgtgacatatcactgtaccagaaactaggtgatgtgactctattttcttgcctctgtgtttttatatggggcatcgtgacatatcactgggccttgcacccaagtgatgggagttttctctcctgctttggtgccgtccacaatgaaaattgtgaaatattgctgccctccccactaggttatgttactctcctgcctctgctttgcccacatgggtcactgtgacatattgctgggtctaaaacccaggtaatgtcactctcttgtttgggttctgcctgcaggagtcattgtcacatatctctatgctcatcacccangtaatatgattcccttttactgcttagttccttctcacaaaacaacttgtgacatattgctaggcccaatacacctagctggtgtaactcttcttttcttttctttcctttttttttttttttttgagatggagtctcactctgttgcccaggctggagtgcagcggcatgatttcagctcactacagcctctgcctcctaggttgaagcgattgtcctgacttggcctcccaagtagctgggattaaaggcatgtgccaccacgcccggctaatttttgtatttatagtagagacagggtttcgccatgttggctaggctggtttcgancttctaacctcaggtgatcctcctgcctcggcctcccaaagtactggaattacaggcatgagccactgcacctggcctgattcttctcttctttctaggtttcaactgcagcagagattgtaacaaaccactgggcccagccgcataatgatgttactcttttgccttgggcctgccctcagaaggcactgtcacatattcatgggcccaacgccaaggtgatatgtgtctccagcctggaccctgcccacagggggcattgtgacatatctcttggcccatcagatgtttgattgttatcccctcccctcttctaccctgtgtttgcctataaaagacacagtcatatgttcctgggcccagcacctaggtgttgtcttactggaatgtgtccacatggggattgtgatatgtcacgtggcccagtacttaacttgatgtgactctcctctcatgcctaggccttgtagagaatccccttccccttttgttttcctttttttctttgcagatccaggagataatcaactaagagccaggcacccgtttaggtctaataaacattttacaaactgctctctcttttaattcacctatctgagagattcctctgtacaataaaacttggtctccacaatcctttaccttaacctaaaccttccctttcattgatcccaggtcttcagattccaccacttgtcaaccacaaaatatttaaatttacctggaagccgcccgctttgagttgtcccgcctttctgaaccaaaccaatatattcctgcaaaaccggccatgat

SEQ ID NO: 6012 - DNA, 2658 bp, Homo sapiens
  misc_feature (1530)..(1530): n is a, c, g, or t
  misc_feature (1860)..(1860): n is a, c, g, or t
atcttctctccagcctggctctttcacagggggcattgtgtcatattgctgggccccacacataggttatgtgagtctcctgcctgtgccctacccatgtaggccattgtgacatattgctgggtccaacacccaggtgatgtaactctactgcctcggtcctgcctacagcggacattgtgatataaccctgcacccatcacacaggaggagactgtaacgtatccctaattgagcacccaggtggtgtgacacttctgccctgtccctgccctcagaggagattctgacatatcactgccccaaaatgcagcacctgagtaatttgactctcctgcctggacccagcgtacagatgggattgtgcttcattgctggacccagcatttaggcccactacctatgagattgcatgctcctgcctgggctgtgcccacagtgaccttgtgacatatatctgcatccatgacctaaaagatgtgacacttcttgcctgcaacctgccctgcacaggaaagattgcgacttctccctggaagcagacaccagggatcgtcactcccgtggatgatcaaagctactccgggggctgaggcaggagaatcgcttgaactcgggaagcagaagttgcagtgagccaaggtcgcaccactgcactccagcccaggcgacattgtgagactccatctcaaaaaaaaagaaaaaaagtgtactaacaagacccagcacacagaggagacttttaccattgtatgaacacccatcaaacagtacacatcatcattgtgagttctgaatctcacacatagaggaagtcaaaggtggaaaacttgactctcatatttggatccagtccacaggtgtgattttgacgcacacttctgcccagcacctgagtaatgtgattcttcagaattggcccggcccacaaataggattgtgccacactgctggacccagtgcctaagtgatgtaactctattcttctgccttggtgctactcgaaaaagacattgtaacatatctcagagccttacacccaggtaatgtgagtctcctcttctgccttgctgctgcacacagaagcggaatatgtacaggattgttaatctcatcttggatcttcctgcacttgtgattgtgacacatgcctctgtgtagaacctgagtgagtttactctcctgcctggatttaacccatagatggaatcgtgacatatcactgtaccagaaactaggtgatgtgactctattttcttgcctctgtgtttttatatggggcatcgtgacatatcactgggccttgcacccaagtgatgggagttttctctcctgctttggtgccgtccacaatgaaaattgtgaaatattgctgccctccccactaggttatgttactctcctgcctctgctttgcccacatgggtcactgtgacatattgctgggtctaaaacccaggtaatgtcactctcttgtttgggttctgcctgcaggagtcattgtcacatatctctatgctcatcacccangtaatatgattcccttttactgcttagttccttctcacaaaacaacttgtgacatattgctaggcccaatacacctagctggtgtaactcttcttttcttttctttcctttttttttttttttttgagatggagtctcactctgttgcccaggctggagtgcagcggcatgatttcagctcactacagcctctgcctcctaggttgaagcgattgtcctgacttggcctcccaagtagctgggattaaaggcatgtgccaccacgcccggctaatttttgtatttatagtagagacagggtttcgccatgttggctaggctggtttcgancttctaacctcaggtgatcctcctgcctcggcctcccaaagtactggaattacaggcatgagccactgcacctggcctgattcttctcttctttctaggtttcaactgcagcagagattgtaacaaaccactgggcccagccgcataatgatgttactcttttgccttgggcctgccctcagaaggcactgtcacatattcatgggcccaacgccaaggtgatatgtgtctccagcctggaccctgcccacagggggcattgtgacatatctcttggcccatcagatgtttgattgttatcccctcccctcttctaccctgtgtttgcctataaaagacacagtcatatgttcctgggcccagcacctaggtgttgtcttactggaatgtgtccacatggggattgtgatatgtcacgtggcccagtacttaacttgatgtgactctcctctcatgcctaggccttgtagagaatccccttccccttttgttttcctttttttctttgcagatccaggagataatcaactaagagccaggcacccgtttaggtctaataaacattttacaaactgctctctcttttaattcacctatctgagagattcctctgtacaataaaacttggtctccacaatcctttaccttaacctaaaccttccctttcattgatcccaggtcttcagattccaccacttgtcaaccacaaaatatttaaatttacctggaagccgcccgctttgagttgtcccgcctttctgaaccaaaccaatatattcctgcaaaaccggccatgat

SEQ ID NO: 6013 - DNA, 925 bp, Homo sapiens
gcatccggcatttggcggggcttttgtctctcgctgcagccagagcttgggatcgctttctgctattcaacgtcctccacctctgcccccctctccccccagccggtgacaggctgttgccctgtgatctgcaggtcctgggacgtgcacagacagctaagatgccaggacattccagaaggtgggaaaggcacctgagtaatttgactctcctgcctggacccagcgtacagatgggattgtgcttcattgctggacccagcatttagggatcgtcactcccgtggatgatcaaagctactccgggggctgaggcaggagaatcgcttgaactcgggaagcagaagttgcagtgagccaaggtcgcaccactgcactccagcccaggcgacattgtgagactccatctcaaaaaaaaagaaaaaaagtgtactaacaagacccagcacacagaggagacttttaccattgtatgaacacccatcaaacagtacacatcatcattgtgagttctgaatctcacacatagaggaagtcaaaggtggaaaacttgactctcatatttggatccagtccacaggttctgctagcaaggaagactgagacatattgtggggctctacgccaatgtgacattactgttctgccttggcctgtacctgaaaaggcattgtgacatattgctgggcccagcaacaaggtggcatgagtcttccgtatggaccctgacaacagagcattgtgacatatctttaagagcatcaactatttgatgtgactctccttttctaccaaggctttcctcatatgagagattgtgacacatcttctggcacagaaatcaagtgatgtgtttctcctgcctgagctttgctcatagaaagcattgtgacatatctctggtctcagcacccaggtaatgtga

SEQ ID NO: 6014 - DNA, 479 bp, Homo sapiens
tttaccctgatgtgattattatgtatcgtatgcctgcatgaaaatatctcatatatcccataaacatataacctatcacccataaaaattaaaaagaaaaaagaaaataacttttaaactattactcattgagtagtgtcaacattttttcagcacttgattaacttaatgatgaattgaataactattacagaattaaataataaaacataaactattttctgaattgtatatagatatgtgggcaaaaaaaaaataaaagtaacataggccaggcacagtggatcacacccataatcccaacattttgggaggccaaggcagaaggattgcttgagctcaggagttcaagaccagccctggtaacatagcgagacctcatctctacaacaaatacaaaaattagccaggtgtggtgacacatgcctatagtcccagctacttgggaggctgacgtgggaggatcgtttgagtctggg

SEQ ID NO: 6015 - DNA, 426 bp, Homo sapiens
gtccctcttattcagaatgtcctgtttaggaagaggtgctatggggatataaaaatgattaagacatgaatattgccttcaagaaatttatggtgacttaaaaagagatcgctagggtagaaataactataatttcaggtagaaagtatcaagtgttgtaaaactacaagacagcattctgtgtgtcttcaaaggaggcagaataatttccttcacctgtggctgtgatgggtgattttatgttatagatggcatttgagctaggccttgaagaacagatgaggattagatatacagagataagtacttagaaagttggagaaaggagacttgttcaagcaaaagggagcacatgtgcaaactagagacaataccagagcttatgggaggtcatgaggtcatagtatgtgggaaagggggaaagtg

SEQ ID NO: 6016 - DNA, 298 bp, Homo sapiens
actgagtcaccaacaaattcatgtgacttcacacattttctctctcctttgatacataatgaaagacatcactgctcacttcagatgcagcagaagacacagcatgtagaaatgtcaggtattttcataagcctcagaggactgaataagctttgaattttctgttcagagtggggttagtaattgggaagactcacgtgacttgataaaataatcttacacacttgcttagaagagtggcaaggttcttgtataaattgattatttttgtttgacaaatgttctttacagaaatcac

SEQ ID NO: 6017 - DNA, 1273 bp, Homo sapiens
gttaatatctgtatgagttggacaaaccatataaccatctgttgccttccttgtttcctctttaaagtgtttaatccgcaaaacaaacctgataaagtgagattaaattgaatagtacctggcccaagtaagtgttcttcagtaaatgttagtgattattacacaatggcaaggtggctatccatttgaaaaaaaattaggccgggcgtggtggctcacacctgtaatcccaacactttgggaggccaaggtgggcggatcacctgaggtcaggagcccaagaccagcctgaccaacatggagaaaccccatctctactaaaaatacaaaaaaacaattaggcaggcatggtggcaaatgcctgtattcccagctactctggaggctgaggcaggagaacgcttgaacctgggagatggaggttgtgatgagccgagatcatgccattgcactcattccagcctgggcaacaagagtgaaactctgtctcaaaaaaaaaaaaaaaaaaagagagagagaaaaaaattagtttcctacttcacatgattcataaaaatatttcaagtggatcaaagacctaagttttttttttttttgagacagtttctcactctgtcacccaggctgcagtgcgttggcacaatcatgactcactgcagccttgaccttcccaggccctgatgatccaccccagcctctcaagtagctgggatttttgtatttcttacagagatgggattttgccttattgcccaccttggccttctaaagtattgggattatgggcatgagccactgcacccaccctaaacttatttctaagctatggaagcattaggaaaataaatgtaaagaaaaacgtgtttatcacctttggatagaattcttaagcagaatctaaaaagattgaagagtttgaatatattaaaattatagatttctgtgcaagacactcccctcccctaaaaaacaagtgactgatgagattttccaatacatgtaacaagggtttagagaaatgagtactgatgtcatgctgacagaagtgcaaatatttatggccattttttacagctgttgacaagatccactaaaataaaaattgcagatatcctgtgagcccaattctatttttttggtaactttatagtatcatacaggtgattcactttaaaatacctctgcatggacaacgtgatatgtatgcgaagaaacattcacatgtgtacaaggaagcaggtagaaggatgtttactgcactgctgcttataaa

SEQ ID NO: 6018 - DNA, 438 bp, Homo sapiens
gcaaataagcaagaatctaaatgcattctaaaatacatattattatatatcaatttaagaaactggctgggtacagtggctcacgcctataatccagcactttgggagtctgaggtggaaggatttcttgagcctaggagtttgagacaagccagggcaacacaggaagaccccatctctacaaaaataaaaatggaaattaggcaggcatggtggtgcgtggttgtagtcccagctactcaggaggctaaagtgggaggattgcttgaggccaggaattcaaggcttcagtgagctgtgattacaccactgcattcctaactgggcaacagagggagaccctgtctcaaaaaaaaaagaaagaaagaaagaaagaaagaaactgcaattttttttccagagttattttagaaactttttttttaaaagtaaaagaaa

SEQ ID NO: 6019 - DNA, 350 bp, Homo sapiens
agaatcaccaatatttggggtgtttgtttaattttttagcttcctaaaccctagcacaagcccaatgaaggtgggaagaggaatctgtattttagaagcaaccctttcccctccaaattcttcatagagtgattgtgatgaataaaggttgaggaccatctggtttaggctgttctaggcagggtggagatgtagggaaggacacacaataaccctgttactcggttgtgctgtggttatgtgcctatacactatcagacagactggtcaattttgttccaaatatgttcagtgttaaacagaacccagtattgtaaactgtaattacaaattataaaacttctgtaaac

SEQ ID NO: 6020 - DNA, 473 bp, Homo sapiens
aaatggcctttcctacatttcgagtttctcaccaggcaatgccttgtggaaacccccccaggttacctgtggggacagtgttttattctctctaagggctgtgcagttttccacagtgtgggcataccatggtgtgttcatttcctctctttgtgcttatcttaataccaggatcttttagagacccttacaaagaaaaactagtgaatgaaactgcagaggctcccatttatatcaacagagacagtttctgaaccatcagtaactcacacatcagcccctacttatagtttatgtagtcatctcagaattgggtttcataagctgggtgtggtgtgtgcctataggtagtcccggctactcgggagactgaggcgggaggatcacttgagcctaggaggttgaggctgcagtgagccgtgatcgcaccactacactccagcctgggtgacagagtgagatcctgtctcaaa

SEQ ID NO: 6021 - DNA, 888 bp, Homo sapiens
caaaccaaacaaacaaacaaacaaacaaaacccactaagtatgcattggtctaggactaccatttatgaatatccttagtctttctgtgatgatccttgttgaaaatttagattgatgatgtagtttgtgatgttgatacaagtgtatttgttcacagagatttgagcatattcctttcaacatcaggaataacttttagtttttgtttgattgtaattttttagtctccattctctgtaatgtgctttacgttgaacaaagtgcttttgtagttcttgttattttgaacccataatctgagacctttttttctaagccgtctcgtgccccagcccttacttactgagccctcttattgtatatactgaacgcatttttaaattgaagagatactattctgtgtatctttgcaggcgaatgagtcctaggttggccagtgtctcactagttgagattaaatttttgcttatacttgttgatttgactgccttctgaatagtattaggaacacattgtaaatttgttgttgatggctggctgaagttttccagcacatttcttgaggttgccaagttcttctacaatgactgaatctactcttcattcattctagtcagcagtctcacacttaattccaaggtttacttaagatttttttctgaaaaagcaatgcttgctttccatatttgcatattttttctctgccttaatagcagaaacaatggcttcatcttgcatttgtatcagattctttccattgatatatcttgtccttattagctagttgtttcccagctgggtgcagtggcttatgcctgtaatcccagcactttgggaggtcaaagcgggaggattgcttgagcctaggaattcaagaccagtctggg

SEQ ID NO: 6022 - DNA, 834 bp, Homo sapiens
caaaccaaacaaacaaacaaacaaacaaaacccactaagtatgcattggtctaggactaccatttatgaatatccttagtctttctgtgatgatccttgttgagagatttgagcatattcctttcaacatcaggaataacttttagtttttgtttgattgtaattttttagtctccattctctgtaatgtgctttacgttgaacaaagtgcttttgtagttcttgttattttgaacccataatctgagacctttttttctaagccgtctcgtgccccagcccttacttactgagccctcttattgtatatactgaacgcatttttaaattgaagagatactattctgtgtatctttgcaggcgaatgagtcctaggttggccagtgtctcactagttgagattaaatttttgcttatacttgttgatttgactgccttctgaatagtattaggaacacattgtaaatttgttgttgatggctggctgaagttttccagcacatttcttgaggttgccaagttcttctacaatgactgaatctactcttcattcattctagtcagcagtctcacacttaattccaaggtttacttaagatttttttctgaaaaagcaatgcttgctttccatatttgcatattttttctctgccttaatagcagaaacaatggcttcatcttgcatttgtatcagattctttccattgatatatcttgtccttattagctagttgtttcccagctgggtgcagtggcttatgcctgtaatcccagcactttgggaggtcaaagcgggaggattgcttgagcctaggaattcaagaccagtctggg

SEQ ID NO: 6023 - DNA, 597 bp, Homo sapiens
gcagctaataaagagctgaacttggccactttgttgtgcccaggatacaagctgctgttaatttcagtacctgtttcttctgctgttagaactaggaagaaaggatttagtgaccctctttcaaaaggtggatcacaagcttagaggcattgctggataaattcaacagcaagactttatttcttccccagaggtgacgtctgatggttctgtataaataaagtcacaccacctttcttatgctgaattgatgctgctgacctgctgttagtaggacatgcacttttatggcgtttccaggagtggtgatgtgtgttgctgagctcatctaatctctgctttgagcaaaggcaatcctctatatcatggcagggattagaggtatagcctggggctgcagaatggtgtgatttaaattttcccatgcaggttcaaagcttgtaactttgcctgcgtgtacatccacactgggttccagccacatgaactgggccaccttcatagacctccctggtaaccacagcctgacgtgacaaggaatcacagttttactttctgcttactatccatgttagaaatatctaaggaaattcagga

SEQ ID NO: 6024 - DNA, 440 bp, Homo sapiens
tagggggacagaagttacaatcagagacataaatcaatagacgcaaggtgtacattgattttgcccagaaaggcaggacatctcaaaaggggaagccttgcaagtcaggtggatttaaagatttctgattggcaactggttgaaagggttaaatttgggccgggcacagtggctcacacctgtaatcccagcactttgggaggtcgaggtggggtggatcacgaggtcaagagttcaggaccagcctggccaacgtggtgaaaccctgtctctgctaagaatacaaaaattaggcaggtgtggtggcacatgcgtgtaatcccagctactcaggaggctgaggcaggagaattgcttgaacctgggaggcagaggttgcagtgagccaagattgtaccactgccctccagcctgggcaacagagcaagactctgtctcag

SEQ ID NO: 6025 - DNA, 442 bp, Homo sapiens
agtcccaaccaaagtcatcatgccttccattattcttggtcacgtccaagatggagtccaatctagttatcttttgtacttttatcccttttgtacttgtgcttctctcctaatccaatgacttgtcactgggttccctcccagacttctccactgagcactttgggagggcgaagtgggcagatttcatgagcccaggagtttgaggccagcctgggcaacatggtgaaaccccatatttacaaaaaatacaaaaattagccatatatggttgtgcacgtgtgaggtcccagctacttaggaggttgagctggaaggatcacttgtgcctaggaggttgaagctgcagtgagctgtgattgtgccactgcactccagccttggcgacaggagtaaggccctgtctcaaaacaaaacaaaatcccctgaaacaacagaaaga

SEQ ID NO: 6026 - DNA, 321 bp, Homo sapiens
ttgaattgaattccttggtaggtagctataaacatagcagatacactaaggctttctctatgcaatataaaatgtctctcagagaaattcatggcactaaaagcatatataagaaaagaagaaaattatcggatcaataatctaagctcacattcaagaacctagaaaaagcgaataaaataaacacaaagcaaatgaaggaaatataacaaagggcagaaatcaatgaaagtgaaaaacaaagaatagagaaaattaacaaaactaagagctggttctttgaaaagatcggtaaaactgataaacctctagcaggactga

SEQ ID NO: 6027 - DNA, 381 bp, Homo sapiens
ttttgtaaggcttaatacagtgtgttactctaaattaaaaattcttggactagatacagaaagaactaaccataaaagaaaaaactgggccgggtgcagtggctcatgcctgtaatcccagcactttgggtggccgaggcgggtggatcacaaggtcaggagatcacgaccttcctggctaacacggtggaaccccatcacttctaaaaaaatacaaaaaaattagccgggtgtggtggcgggcgcctgttagtcccagctattggggaggctgaggcaggagaatggcatgaacctgggaggcagagcttgcagtgagctgagatcatgccactgcactccagcctgggcaacagagcgagactccatctcaaaaataaa

SEQ ID NO: 6028 - DNA, 308 bp, Homo sapiens
cagggatttaagattgcctattccattgtaccttttgactggtataagcttgacaagcctttctctcaggtgtctaaatttttgtcatgtgttatttcatagttacatgtttataggcactttatagaccaaaacgataaattatgaactagaacgtgaacacgttgtgaagatatgcagaaaaaaaggaaacatttttagacccagaaaaatatatccctgttccaatctgagttgcattacctagttctgagttctgtatccttctatcagattccattgcaatctgccagtgagttgaacagtta

SEQ ID NO: 6029 - DNA, 662 bp, Homo sapiens
gccctggtacttgcatagtggcaaaatgtcccaagctggaggaaatggataagaattgggtacacatcacccgtactgggaataaacaaatgtgttctgattatttggaaaaagcagacattctaggggtagggagttctaaagccttggtgcacttgaatggataaacttcccaggagcagagttttccaagcatggctccctgtggttcacctctaccaagcttaacctaccttctgcttaggcagagcgaagaggcacctcagcataactcagatcaaaatggaagcatctcatttcttaaaagctgtcaaagaattggtgtgaggtttaaaaacgtctctgagcttgatggaaggaaggtaggcggtgatagttcatgctccctttcctccagacacttctcattttcctttcttaacctgctttgatattatgatttcttttgcttcatttgttaagttctcttacaacacttcttgttcacaagtgagtgaagagctgttctctgcttgtaacgttggaaatgggggagtgtttcagaaatgacacaacaaagcattaagccatgaaacaagaaggggaacttcagacagaattacaacagtcatttgagaatctcactgagagctaataaaagccacacacacacagaaggagtg

SEQ ID NO: 6030 - DNA, 586 bp, Homo sapiens
atggcatgtctctgctccaggatggccagggtctcatttggaatatttgaatgctgggggctagaatcacctgaaggctcattcactcacatctggtgatagattctggctgtcctgagacctaagattgttggctagaacacctacatgtgacctctccaagtggcttaggtttccttaaaatatagaggccaggttacaaaggtaagcactgagagagagagaaagagacaatctgtaccttgtaagtcaatagcatcatggtgccatactccttggttacggcaaccacaagccccacccaggggtgggaaaacaaaccccacccaatagtgggaagagtaccagttattgcaagaagagcatgtggaatgggataaatatactgatggaaccatctttggaaaaatacaatctcctgaagattctttgctttcatgtaagagaaaacccaaacctaaatggctttcaaaaggggcaatttattggctcacgtatgtgaaaactccaggggttgggctgactccaaataaggcttgactgagtctagagctatgtcaccagaacccactttctctttttcatc

SEQ ID NO: 6031 - DNA, 2255 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6032 - DNA, 1286 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgaggtgagagcgggcgggcttgggagccggcaggtgcgggccgagggcgggcacagcggccggcggagctgaggcgcgcggcggggaaagctcggccggcctcccgggccccagccttctccagaacccctgctacccacgactaagccccgaacaatctgcccttgggcttgttctcttcgcagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccagggatcaacgctggaattgggggcctggggtttcacgcgcggcctttctcaaagagtgcaaacgagacccgggaaacgccggggcgagaacaacgactggggccctctggcgttggatgtggcgccgcaccaagaggacggcctgtgtggacactacagcggccccgagaggtcagcgtgcacggagaaataaacgcgctttgggcagaggccggcaactgagcgccatatcgggaccaacctcagtggggacaggaaaagactaagaagcggacgcgcagagagacacaactgagcaggacagaatagtctcgtgatgcgcgtgcgtcgtgtgattggagtaaattgtactgagtgcgggagc

SEQ ID NO: 6033 - DNA, 1237 bp, Homo sapiens
  misc_feature (1237)..(1237): n is a, c, g, or t
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggaaatccaggtgatgatgcgcagctggtggtcctgcggtggctggaaaatcaacctaatgcaactggtgggcaaggcggcacggggcagagattcgggagaacctttaccgggaagccggtcccggcgcggcaactggtgagtccccctaacggagatagacctggagggagggcggcggtgaacacacagggtgcatgagcggcatgccggggtcggccaaggaagagcaggaataacaggaaagagagacacgagtgggcaccgcgagagagaacaccacagacgtaaggaggagcaaaaaggagaacgaacggaaacgcagatacgaaacgagcaataatcaggagcagcgacacggcacaggcgn

SEQ ID NO: 6034 - DNA, 470 bp, Homo sapiens
ttccaaagcggagatgctgactaacgcatgaagcccaatccgtggccatcattaacaacactggagccaggacactgactaacgtctgaaacctgatcggtgacactcattaacaacactggagctggggttacaggctgactggtcattcctctcttgggctcacatcagcggaccctcagagccagcatctccgctttggaaatttccaaagcggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcatctccgctttggaaaggtaccgagctgattctc

SEQ ID NO: 6035 - DNA, 571 bp, Homo sapiens
accttatgccggggctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6036 - DNA, 423 bp, Homo sapiens
ccctactgtactaggaggattgaagaggagtaattttctcgccatgcaactcagtgcgtagcctggggactgtctccactgctacggttgtggggtggggtctgcagtctgcactcgaggtcagcatgtcatactcagcctccccaggactgagatgggaacaagagaggcccaagtggctggcaggagaccaagctcctcaagcaaagcccagctctctggcctgtctttggcgggtgagcttttattatgtgcatagcagagaactttggaaacaccatcttccagtggtgggatctcttctctctctccttgtaggaatcaacgctgaatgtggacttggatttcaagcagcctttcctagagttgaatcgaatccccccacatatcaagcttatcgatacaaacgacctcgagagcgga

SEQ ID NO: 6037 - DNA, 263 bp, Homo sapiens
atgtgtttggtgtatatcttctttttgttttttgtttttttgagacagggtctcactctgttgctcaggctggaatgcatctgcctgccttgacctcccaaaatgctgagattacaggtgtgagccactgctcccagcctatatgcatatacttttaatttacataaatggattctgcctagacctcatttttttccacctcagtgccatgtgtggagcttgtcgatgttgctctgggtatatttgggatgcagtttctaaat

SEQ ID NO: 6038 - DNA, 2142 bp, Homo sapiens
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6039 - DNA, 2148 bp, Homo sapiens
  misc_feature (51)..(51): n is a, c, g, or t
tacgaggctgggtttgaattcggccgaggggaagcggggcggggctgcggngcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6040 - DNA, 2437 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgaggtgagagcgggcgggcttgggagccggcaggtgcgggccgagggcgggcacagcggccggcggagctgaggcgcgcggcggggaaagctcggccggcctcccgggccccagccttctccagaacccctgctacccacgactaagccccgaacaatctgcccttgggcttgttctcttcgcagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6041 - DNA, 2775 bp, Homo sapiens
gggacatttgcgttgagaccctaattaggaggcaggcttagtgaagatacgggaagagagtggtccaggcagcgggaacagccagtgtgaaggccctagggcagaaatcaactgagagtatagtcaaggaacagaaagcaagctagtgtggctaaagtatggtaagaaagggaaagagtggtaggagatgaggtcggataattggggtttggtcacatagagtctgtaggtcagagagaggaatgtggagtttttttctaagtacagtggaaatcttttggttttaagcagaggagtgacatgtagggtagagagtggatgttggtcaggctggtctcaaactcctgaccttgtgatccgcctgcctcggcctcccaaagtgctgggattacaggcatgagccaccacgcccagccgatgttgtctaatctttgtcaggcaaaagggacctttatgatttgctcaaacttcctttctccttacacaggagccccttgtttcaggatgctaaatactccaggataaacctccatacatgcctttgtggagattttaatatttcactcatgtctcttttctacccactcctacacatttgagctcaggttctccagcgcagttaggaaatggatgtgtcatttaatcagcaaatgtgtgtgtgtgtttttttaaatttgagacggagtttttgctcttgttgcccaggatggagtgcaatggcgtggtcttggctcactgcaacctccacctcctaggttcaagcgattgtcctgcctcagcctcctgagtagctgggattacaggtgcccgccaccacacctcggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6042 - DNA, 2889 bp, Homo sapiens
ggtgaaaccctgtctgtactaaaaaatacaaaaattagctgggcgtggtgtcatgtacctgtaatcccagctatttgggaacttgaggcgggtagattgcttgagtccgggagtttgagaccagtctgggtaatatggtaaccctgtctaccaaaaatacaggtattagccagtctcataactcggtctcaaaataaataaatacatacatacatagatgaaaatttaaaaaataaagtccaactcagcggttttcagcatatttacagagttgtacaatcttcaccactatctaatttcagaacattttcatcacccccaaaagaaacctaacccattgactatctctccatttcctccctctccctagcctctggcaaccactaatctcttttttgtctctatagatttgcctattttggacagttcatatacaaggaatcataccacatgtagccttttgtgtccggcttctttgattaatagaatgttttcaaggctcatctatgctgtagcctgtatcagcacttcattcctttctatggctgaataatagtccactgtagggatgtgccatgtttttccactagctgatggacatttgggttgtttccaccttctggctattataaatattgctgctataaatattcacttacaagtttttgtgtggacatatgtttttatttcttctggtatatccttcggagtggaactgctggatcaggtggtaactctaggtctaacctggcagttaaacagaatcctatgcatgctgtagtccatgagttgaaataaacacttgacccatagtaagtgccagatcatcttcatttcacagcaaccagtaatttcacagatgaggaaatgaaggctcccagaggtgaactggcttttcccatttgagcagttccaagtcagacagttaaaaagtggcaggacctggaagagaagctagttctttcaccctggcattcagggctgcctcctgggctacggggctggcatttagaatagagctaaggtctgctgccaaggcaggtgccccagtctgcctcctctgtgtccttattccactttctctgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6043 - DNA, 3037 bp, Homo sapiens
attttttgtatttttttagtagagatggggtttcaccgtgttagccaggatggtcttgatctcctgacctcatgatccactcgcctcggcctcccaaagtgttgggattacaggcgtgagccaactccagcctgggtgacagagcaagactctgtatcaaaataaataaataaagtacaactctggatgggcatggtggcttatgtctgtaatcccagcactttgggaacttgaggcgggtagattgcttgagtccgggagtttgagaccagtctgggtaatatggtaaccctgtctaccaaaaatacaggtattagccagtctcataactcggtctcaaaataaataaatacatacatacatagatgaaaatttaaaaaataaagtccaactcagcggttttcagcatatttacagagttgtacaatcttcaccactatctaatttcagaacattttcatcacccccaaaagaaacctaacccattgactatctctccatttcctccctctccctagcctctggcaaccactaatctcttttttgtctctatagatttgcctattttggacagttcatatacaaggaatcataccacatgtagccttttgtgtccggcttctttgattaatagaatgttttcaaggctcatctatgctgtagcctgtatcagcacttcattcctttctatggctgaataatagtccactgtagggatgtgccatgtttttccactagctgatggacatttgggttgtttccaccttctggctattataaatattgctgctataaatattcacttacaagtttttgtgtggacatatgtttttatttcttctggtatatccttcggagtggaactgctggatcaggtggtaactctaggtctaacctggcagttaaacagaatcctatgcatgctgtagtccatgagttgaaataaacacttgacccatagtaagtgccagatcatcttcatttcacagcaaccagtaatttcacagatgaggaaatgaaggctcccagaggtgaactggcttttcccatttgagcagttccaagtcagacagttaaaaagtggcaggacctggaagagaagctagttctttcaccctggcattcagggctgcctcctgggctacggggctggcatttagaatagagctaaggtctgctgccaaggcaggtgccccagtctgcctcctctgtgtccttattccactttctctgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6044 - DNA, 2579 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgaggtgagagcgggcgggcttgggagccggcaggtgcgggccgagggcgggcacagcggccggcggagctgaggcgcgcggcggggaaagctcggccggcctcccgggccccagccttctccagaacccctgctacccacgactaagccccgaacaatctgcccttgggcttgttctcttcgcagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagggtctcactctgttgctcaggctggaatgcagtggcataatcatggctgactgcagccttgacctcccgggctcaagcaatcctccgtcccacctcagccttctgaggagctgggaccacaggcgtgtgccaccatgcccaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6045 - DNA, 2257 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgagggtctcactctgttgctcaggctggaatgcagtggcataatcatggctgactgcagccttgacctcccgggctcaagcaatcctccgtcccacctcagccttctgaggagctgggaccacaggcgtgtgccaccatgcccaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6046 - DNA, 2115 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6047 - DNA, 2372 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagatggagtgcaatggcgtggtcttggctcactgcaacctccacctcctaggttcaagcgattgtcctgcctcagcctcctgagtagctgggattacaggtgcccgccaccacacctcggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6048 - DNA, 2397 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcagggtctcactctgttgctcaggctggaatgcagtggcataatcatggctgactgcagccttgacctcccgggctcaagcaatcctccgtcccacctcagccttctgaggagctgggaccacaggcgtgtgccaccatgcccaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6049 - DNA, 2280 bp, Homo sapiens
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcaggtgggtggccacccttgcaagtgccctgcgacagcctccctgaggacatgggagacccgaagctactgagtgacagggttccggaaggacgatgatgaggatgttggtacctgcatctgtaggcctccttgaaaccggccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6050 - DNA, 1854 bp, Homo sapiens
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcatctccgctttggaaaggtaccgagctgattctc

SEQ ID NO: 6051 - DNA, 2060 bp, Homo sapiens
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccaccccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6052 - DNA, 2103 bp, Homo sapiens
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6053 - DNA, 2469 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggagtaaggaggcccttgggtgggccagcagcactctgcttcgacctctcagggcacagggcttgactgtggtcttcatttcacccagatgtacttgacttgcctgcagccctgtctcaagagcctcacacaggcttttggggccctcctctcaggtgctggctctcaggtcctagcccccaccagctctacactaaactggcccctttcttcccagatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6054 - DNA, 1773 bp, Homo sapiens
cacgtggccggctccaggcgtggggtgggagcaccctgaagctgggatgtacaaggactcgaaggagagccagcaagagtgcccgcatcaccaggccctgtctctcctccttcgtcagaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6055 - DNA, 2185 bp, Homo sapiens
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagttgctcggactcaaacgtccagtcctcgtgcgaccgcgctgggtcggaagtgagcaggctgaggccaccatggagcagtgtgcgtgcgtggagagagagctggacaaggtcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6056 - DNA, 2046 bp, Homo sapiens
ccctactgtactaggaggattgaagaggagtaattttctcgccatgcaactcagtgcgtagcctggggactgtctccactgctacggttgtggggtggggtctgcagtctgcactcgaggtcagcatgtcatactcagcctccccaggactgagatgggaacaagagaggcccaagtggctggcaggagaccaagctcctcaagcaaagcccagctctctggcctgtctttggcgggtgagcttttattatgtgcatagcagagaactttggaaacaccatcttccagtggtgggatctcttctctctctccttgtaggaatcaacgctgaatgtggacttggatttcaagcagcctttcctagagttgaatcgaatcctggaagccctgcacgaacaagacctgggtcctgcgttggagtaaggaggcccttgggtgggccagcagcactctgcttcgacctctcagggcacagggcttgactgtggtcttcatttcacccagatgtacttgacttgcctgcagccctgtctcaagagcctcacacaggcttttggggccctcctctcaggtgctggctctcaggtcctagcccccaccagctctacactaaactggcccctttcttcccagatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6057 - DNA, 1305 bp, Homo sapiens
  misc_feature (29)..(29): n is a, c, g, or t
  misc_feature (73)..(74): n is a, c, g, or t
  misc_feature (81)..(81): n is a, c, g, or t
  misc_feature (89)..(89): n is a, c, g, or t
  misc_feature (98)..(98): n is a, c, g, or t
  misc_feature (101)..(101): n is a, c, g, or t
agtgacatgattatcgctttgagagcccngagagtgagcctagtatgtcgattcagccttgtcgtgacagcgnnatcagtntgtggcanctgtgtacncgntggcttgagagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6058 - DNA, 1119 bp, Homo sapiens
accttatgccggggctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6059 - DNA, 1264 bp, Homo sapiens
  misc_feature (1264)..(1264): n is a, c, g, or t
ggctggtactggctggaattttgggcatggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcgggaaatccaggtgatgatgcgcagctggtggtcctgcggtggctggaaaatcaacctaatgcaactggtgggcaaggcggcacggggcagagattcgggagaacctttaccgggaagccggtcccggcgcggcaactggtgagtccccctaacggagatagacctggagggagggcggcggtgaacacacagggtgcatgagcggcatgccggggtcggccaaggaagagcaggaataacaggaaagagagacacgagtgggcaccgcgagagagaacaccacagacgtaaggaggagcaaaaaggagaacgaacggaaacgcagatacgaaacgagcaataatcaggagcagcgacacggcacaggcgn

SEQ ID NO: 6060 - DNA, 840 bp, Homo sapiens
  misc_feature (21)..(21): n is a, c, g, or t
atgagagcttgttcctgcttnttcctcagctcattttcctcttctgctggcttatatgctttcccaaacgggcatgagacaggaaagaagtcagagggtggtgttgtcttggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6061 - DNA, 1445 bp, Homo sapiens
gcggcggggagcctcggcggtgaggcgcaaagccgcgggctcgtgggacggccacccctccgcaaaaccgccaatgggcgggcccgggccgccgatcgcccgccgcggcttccggttgcgatgacagtggcgccggaagccggggccggggctgcggggcgagttgtcggccctgggccgggagctggagtcccagactcataggtcccggcccagcccccgaagagccgcctcagccggggggagttgctcggactcaaacgtccagtcctcgtgcgaccgcgctgggtcggaagtgagcaggctgaggccaccatggagcagtgtgcgtgcgtggagagagagctggacaaggtcctgcagaagttcctgacctacgggcagcactgtgagcggagcctggaggagctgctgcactacgtgggccagctgcgggctgagctggccagcgcagccctccaggggacccctctctcagccaccctctctctggtgatgtcacagtgctgccggaagatcaaagatacggtgcagaaactggcttcggaccataaggacattcacagcagtgtatcccgagtgggcaaagccattgacaggaacttcgactctgagatctgtggtgttgtgtcagatgcggtgtgggacgcgcgggaacagcagcagcagatcctgcagatggccatcgtggaacacctgtatcagcagggcatgctcagcgtggccgaggagctgtgccaggaatcaacgctgaatgtggacttggatttcaagcagcctttcctagagttgaatcgaatcctggaagccctgcacgaacaagacctgggtcctgcgttggaatgggccgtctcccacaggcagcgcctgctggaactcaacagtccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtatttactgcccttctcatttctcctggccaacctttagcctcactgacaaattatgaccacatgtctaccacacacagggactgggcacggcctggtggctgccgcaaacaaaaacatggccagcaggtatccagtgtccaggcaggaagaacacaacttgcatccctgactgcggggagcttagatgtcagaccccgggcaaggtgcttttacatatacccataccagatcttactaact

SEQ ID NO: 6062 - DNA, 1219 bp, Homo sapiens
gggacatttgcgttgagaccctaattaggaggcaggcttagtgaagatacgggaagagagtggtccaggcagcgggaacagccagtgtgaaggccctagggcagaaatcaactgagagtatagtcaaggaacagaaagcaagctagtgtggctaaagtatggtaagaaagggaaagagtggtaggagatgaggtcggataattggggtttggtcacatagagtctgtaggtcagagagaggaatgtggagtttttttctaagtacagtggaaatcttttggttttaagcagaggagtgacatgtagggtagagagtggatgttggtcaggctggtctcaaactcctgaccttgtgatccgcctgcctcggcctcccaaagtgctgggattacaggcatgagccaccacgcccagccgatgttgtctaatctttgtcaggcaaaagggacctttatgatttgctcaaacttcctttctccttacacaggagccccttgtttcaggatgctaaatactccaggataaacctccatacatgcctttgtggagattttaatatttcactcatgtctcttttctacccactcctacacatttgagctcaggttctccaccgcgccctgccccaatcaacaaatgtttactgagcatctaccatggaccaggccctagtctgggcactgagggggagaaaggacaagactacattccagccatcgagcagctcacagaccaatggaggaggctgacgtggacaggctgttactgtgctgcagtagctgaggactcgatgggtgtggtgtgccactcttgccaggttatgaagcagaaaaggaggcagggagatttcactgagggctcaaggggaggtgataatttaactacagcttacgtactctatacaaagaagtgcagagggcactctaaaaatgggaaaaactgtgcaaaggaagcaaatacattatgcaaagggtttatatgtcaaccatggtagtgttgggcaaaaggtaacaggatctgctatgtgtttcggagggtcatcctggtggataatttctgtatatgtgagaccttggggaggaaggcttaggaccagtggacatgaaatttcaatctattaatcatgaagttggtcaaagacaaacacaattccttgcgcctggtgaagatgactgactgattcaggcagagtggcttgctctagacagccatttaggta

SEQ ID NO: 6063 - DNA, 922 bp, Homo sapiens
gggacatttgcgttgagaccctaattaggaggcaggcttagtgaagatacgggaagagagtggtccaggcagcgggaacagccagtgtgaaggccctagggcagaaatcaactgagagtatagtcaaggaacagaaagcaagctagtgtggctaaagtatggtaagaaagggaaagagtggtaggagatgaggtcggataattggggtttggtcacatagagtctgtaggtcagagagaggaatgtggagtttttttctaagtacagtggaaatcttttggttttaagcagaggagtgacatgtagggtagagagtggatgttggtcaggctggtctcaaactcctgaccttgtgatccgcctgcctcggcctcccaaagtgctgggattacaggcatgagccaccacgcccagccgatgttgtctaatctttgtcaggcaaaagggacctttatgatttgctcaaacttcctttctccttacacaggagccccttgtttcaggatgctaaatactccaggataaacctccatacatgcctttgtggagattttaatatttcactcatgtctcttttctacccactcctacacatttgagctcaggttctccagcgcagttaggaaatggatgtgtcatttaatcagcaaatgtgtgtgtgtgtttttttaaatttgagacggagtttttgctcttgttgcccaggcgtgccactgtactccagcctgggcgacagagtaagactctgtctcaaaaacaaacaacaaaaaaattagccaggtgtggtggggagagaggggaagaatagggacaaaagggaatacataaataaacacaaaggagaaaaggccctgcatggaccacttacatgtgtcatgaactcaggagtgttcatggtgggactacatggtgcacctgtagt

SEQ ID NO: 6064 - DNA, 656 bp, Homo sapiens
ggaaagagaactggaaaagaactgtcctcattcctgattctgtgttagtaatgcctgttctcatcctgcagaagcagcctggacttccacctccccagtggattttacagtcaaatttgcctgagggcattttcatccctgctcagtctcctcaggggcttgggagccaccgggctcagcatattgtgctgtgctgcacagtcctgctgcccgcttgggggtggacccagagccctgcaccccctgagctgccccctctggttgccttgtagagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcaggtacaacccagccctgtgagggcagcacaggtgggagggtagagaggtaatcatcatttgccaaggccctgccatgtgccaggaacagtgctcggtgctttcagagaccgaaactggctttcttagtcattcttcaggagaggaattacctgtttttacagttaaactgagactaggaagagttatggcccgaggtcaccatgaggtcagtggcatgg

SEQ ID NO: 6065 - DNA, 403 bp, Homo sapiens
acacatctaacacagaagctgtagtgtttttataacctaatgtcaaaatccatgtcccatcacttctgtcttttatttgctagatacaagtcactaagtctagcccacacttaaggggagaggtattaagttccacgtctgagtgtagtagtatcacagaatttgtgacccatctttaaagcacaattagtaaatggctgagttgaggtttaagcctaggatgactggcccgaggccctgtgctctgaactgttttattatattgcttccaaatgtcacaaaagcattatagccgaatgctgtgttgaaagaaacctgattcctgccctttggggacttttaattttaagaagtctctctgagaaagtaagatagacatatatgaacaaccaaataagtagag

SEQ ID NO: 6066 - DNA, 402 bp, Homo sapiens
ttttttttttgagatggagtcttattgtctcccaggctggagtgcagtggcataatctcacctcactgtagtctctacctccccggttcaaatgattctcctgccagtctccccactagttaggattacaggaacgtgcttgccatgcgccaggctaatttttgtatatttggtagagacagggttttaccatgctggccaagctggtcttgaactcctggcctcaagtaatccacacaccttggcctctcaaagtgctagcgtgaccagaattagcgtgttcttggtctagacttccaaaatgaagctatggaacctcacagtgagtgttacagttcttaaaggcagcgtgtccaccagcgtttctccctactgatagctcagctgcgttcagtttttttg

SEQ ID NO: 6067 - DNA, 663 bp, Homo sapiens
caaataaaacttcaggaaatagaaaaactcactaaaattacaatctcagaaataaagtttaaaatagtaggtgagataaactaaaagaattctgaaatgaatagaatttcccaggattcaacaaataaattaaatgatgaaaaatataaacaagatgctgagacatggagaaaaaatgagtccactccatcaaaggttctggcagacaacatggactgagcacaaagtcgggttcccatcctcaccgcctttgcctgcctgtgccatagagactggagactaaaagcctcatgctcccagtgttgcatttagctgggggcggccagattccttgcctctgagacacgagtggaagtgcaatagtgctgccttctccttccaccacagggtccgatgtggtcgatggctgtacttgcttccatgttatggtgatgagagaaagaccaagtgcggcatgtaggctttggtgctgacatatgcttcccgcaggacttcttgctatgtggaaaatcaatcccaatttatttaagccactgtagttggcttttccattacatgtagctgaaaatatttctaactgatattaaagtttatttgttcctaaaagagacaattagatagcatggtggagagggaacaaaatcattttgcaaacatacagac

SEQ ID NO: 6068 - DNA, 199 bp, Homo sapiens
aatctcaagccatgaatttagtttcaagttttctggatgagtaggactcctaagtgcctggcagaagcaaatataaatcctccccagaggaagacagcttcatctttgcccgcagaggatctccataaataattgctcaagggcagccggcagcagtcagtcaaagctggagtcaatccaccaggtgacagggcatccc

SEQ ID NO: 6069 - DNA, 511 bp, Homo sapiens
cctacagtgagtactttgttgtgtctgccttctttcacttaacatgttagttttgcaattcatccatgttgttcctttttctccccctgaggtatattcgattgtatggatataacacagtttacttatccattcatgcaaatattgatggacatttgagttgtctccaatttttggctattaaaaataaagctgttctggctgggtatggtggctcacacctgtaatgtccgaactttgggaggccaaggctgggtggatcacttgaggtcaggatttcgagaccagcctggctaacgtagtgaaaccccatctctactaaaaataacagaaattagcgaggtgtggtggtgcacacctgtaatcccagctacttgggaggctgagaaactgaggcacaagaatcactttgaacccgtgtggtggaggttgcagttagcccagatcatgccagcctgggtgacagaacaagactgcttcttaaaaaaaaaaaaaaaaagatgttctgaac

SEQ ID NO: 6070 - DNA, 380 bp, Homo sapiens
ttttttttttttgtagagacaggatttcctcatgttgcccaggctggtcttgaactcctgggctcaagcaatccactcatctcagcctctgaaagtgtaagaattacaggcatgagccaccatgcccggcctgtctatcacttagttcagtaaatgcttggtgaatgaatgaatcatatacatttagtggttgttttgaagttgactctgctgagtgagattttctttgcattcatgcatcttcattaatgtcaactttgttgcagtttttaaaaaagtaatctttgtttacattatcttaagttacttgatttaaaaaagttaaaagtgactatttgcagaattctaaagtcccattactgtcaacatgcataatattt

SEQ ID NO: 6071 - DNA, 436 bp, Homo sapiens
tctcataaacctagtcttagctttctttcaattgtgaagactgactttgcacagtgtcttgatggcagctctccgtttcctcacctgacaatttcactgttttaatagtgagtggaacttagcattgcacgccttcattgcttttctgcttgaaatcttctagttttatttcagattctgagaaacaaataggcaaccctttactctgccactttaatgttgatggtaaaagtggaacttcttccatcaaggagttgtacaggctaaatactgttaagaataagaaattgcttacttatttcatactcaaacatttaggggagggaagcccaggtagaagaatcgcttgagcccaggaggtctaggctgcagtgagtcacattcatgccactgcactccagcctgagcaacagactgagatcctgtctggaaaaaa

SEQ ID NO: 6072 - DNA, 795 bp, Homo sapiens
ccacattgccaaaccttagaggcagagtcatggatgtctcctaattaagttatctgaagcccacatcctctgcctgtcttcagttagatgcctagtgtactcatgggaggggacagatgacaagagtttcagggccaggctttgatgtctgcatcgtgccatttccagaaacccaaggttttcagtcctatcggttatgtgctattccctctaccaaatttataatcttaggtatatttattgtattttttaaaagacttctctctttgtaagcattatttttctagatttggcttttttagttacggtgtaacgtaaatttttagtctgaatctgctaaagttatgatgcttgtggatatcaattattttgagaccaagtaaatctcaatgacatttgaataaaatgtccagcatacctttgcacaggcttgttttgcttgcaaacattaaagtaattctggggtgttgccttgtgttgagatttcttgtgggtaacagttaggggagaccatcccaaattcctgtgggtaatcccaaagagaggcagatctaaaatcttaatgaagttctgagtctgtcttctacaaggcttctttcatggtttggggccctgcccgttggctgttagtaagggatatcctggggggtgctaaatgtgactttaaaaagactgttctttgtatgataaatgatctcttaaaaagaaaactagtcactccctcctgccagcctctaaccacttcctgtaaatgacagcacacagatcttagtttcaccaagtgaaaaaattatt

SEQ ID NO: 6073 - DNA, 460 bp, Homo sapiens
gaatccctggtttgctcaaaaaattctacattctgacccaggtatacacctaccactacaaattgctattctgacttacaaacctttctttagacctttcggttaacgtgatctcttttctcagaattttatctcttgtgggtaagcagtttctgaaacaccaaataatgacagggtccatactgaactgatcctgtagaggccacactaatgcacatccacaacagagtagccagccacaccctgtctctgacaccttatttggctactacacatcagtcaacaactactctagcagccaaggcagaaggtctcacagaattctccaaaccacccacccccagagaatcaagctctggtctccatctgactaccctgaaaacgtgaatcaggtgactggtatgccagactgaacctctatcacagtctaaataaatggaatgtacttccttctgaaaga

SEQ ID NO: 6074 - DNA, 683 bp, Homo sapiens
tctgggttgatgattttggctggtatgttgatagaggtgtgagtttaacaaaccctaatctatatgatgtttcactaccctaatatttatttatttatttatttttaaatctagcttcctcttaagttttatttccctctgttgagggtttaacctagtcacaatcatcttacctttgtggtagtgctaatttatagtttatggaaacctgctgctactgactagtacctcgctaaaggtagaagccgacacacagaatagtaaagctcaggtttgatggtgatctgtaaggagtcacggttcttgctaatcgatgagaaaccatgataactggcagactgcagaagcttttctcttgtcaccggaaccagcagaggctcctgaacgacatttgcaaggctattagtactgcggagaagttactagatggaataatactggtcctgactgaggaaatgaaaaggaacatgcaagttcacgaggttaaatgaggaatggctgattcaaaaaaattaaaaagaaataacgtgatcaacaatattggtttgaaggaatgggagaggttgtctttatgttaagtcttgttgctagaggatctctattttatgttactgttttttgcatactagagtcttctacagatatttgtatgaatgttgtcagtcattctggaaataagcata

SEQ ID NO: 6075 - DNA, 345 bp, Homo sapiens
ggattctggcctatccaaagcatttgggccaaaagtgagggcttccggcttgtttcttacacctgcccctggctcagggccgatgacggtgtccctgtgtccctctgtggcctctcacagtggtcttctcctgggcttcctgttggctgccctgctcatggctgtgctgtggctgctggcagccccacggggctctgaggagcccatgccagcaccttagggcttctgctcttgagccggggctcccacgcagcagcctggggtctgagagtgctggtagaactaaggaaggcaaaacagcaagactgaatggagatgcatgccgagaaatttcacctatttgga

SEQ ID NO: 6076 - DNA, 291 bp, Homo sapiens
ggccactcttacctctgtgataggctatgatgtaaccttagagcataaaagcaataagcgaagtagtaaagagagatctttgaaataagtattgttgaaagagactaggatgatgcatgttttaacactgatcccaaagcatcactctgctttcgaaaataacatcattcaagccttgctatctcttgattggatgatgagtggtggcaatggttttctccatctctcttcctgtgctaaagattaaatgtggccatagcagtggatcagtgcacactgcacatgagtgct

SEQ ID NO: 6077 - DNA, 753 bp, Homo sapiens
ccagaaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctattgatagaaaacatgaagaaagcattaagacttattcagtcagagctataagagatgatagaaaaaagccttcacttcaaagaagtcaaatttcatgaagaaaacctctggcacattgacaaatactaaatgtgcaagtatatagattttgtaatattactatttagtttttttaatgtgtttgcaatagtcttattaaaataaatgttttttaaatctgaaaaaaaa

SEQ ID NO: 6078 - DNA, 381 bp, Homo sapiens
  misc_feature (379)..(379): n is a, c, g, or t
ccagaaacatccagaatacatttccaacaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagtggtttcatgcataagtttagnca

SEQ ID NO: 6079 - DNA, 379 bp, Homo sapiens
ttcatggcagaagccactctgaactcctccttggtcaactttctcagtctattcagatcatattgacaaatttgattagattgtgcaggtatgaaaaagaatggggaagctcttgaagtgctgatccaggactaatctccaaatacgaggttaagtgaaaagaaaacccaggtgcgcagcaatccatcaatccatgttactgcacttttgcaaaaagcacagtggggggggtgaccttaaacaaatctcccacacatattttggctcacacatgcacaatgtatttgtagaagaatacaccatcagctgatcacaatggatgtcttcaggaaagtaaacttagttgccaggggacagacaagaaaaagacttcacttat

SEQ ID NO: 6080 - DNA, 849 bp, Homo sapiens
tgttttattttgcattctttacttttattatttagagtctgaagatgctcatggtaaatgcagattatagagctaactttttgcacaaaaagcccacaaaacagtctttgagagagcatgtcagtgttacgtttggattttaaaagacagtgaagcttagctgagattctgttttacagattttgcgaataaataaaaagacagattccgtttgctctggactgtgttagctgcagtgcggagggcggaaccggctgaaggaactgctgtgtattttcagcacatctcagtcagcttccgtttcagtcttctgtttccatcacccacacaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggtaagccatgagactaaccgcctggaagaaagctttcctattcctgggcaagctttaaaagtttgggattttccactgtcctttccggtgcgagcatttattgaattttgcagtagtctccataatttactgagagctacaggaggagaaacagaaaacagttaggatatgccatgctttccaagaggaactggcaactgcagtgaggatgcatttaaacaaaccagtgtgaggatagatctctctacgttatgcagatccactccatttctaaaagcaagttgaacagcaaatttcagttgatgggaacctatatttgattattttaaaataggaaaacagtgattaca

SEQ ID NO: 6081 - DNA, 2071 bp, Homo sapiens
  misc_feature (4)..(4): n is a, c, g, or t
  misc_feature (7)..(7): n is a, c, g, or t
ggcncgngagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaagg

SEQ ID NO: 6082 - DNA, 2006 bp, Homo sapiens
  misc_feature (4)..(4): n is a, c, g, or t
  misc_feature (7)..(7): n is a, c, g, or t
  misc_feature (1934)..(1934): n is a, c, g, or t
  misc_feature (1954)..(1954): n is a, c, g, or t
ggcncgngagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcttcaaancccactactacttattttgnggcaacaaactcctccatttggcttacccgcttcatgctgctcgaaaggcaa

SEQ ID NO: 6083 - DNA, 1954 bp, Homo sapiens
  misc_feature (5)..(5): n is a, c, g, or t
  misc_feature (7)..(7): n is a, c, g, or t
ttcgnanacaagtgcctttgtaatttagcaaatatcatttttggtgtacagtataaatttcctttttataaagatctgagtttttaactttgctgtcactttctgtgtttcatgacttaaatattttaattttttctttttttacatttacattttttattctagttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6084 - DNA, 2196 bp, Homo sapiens
  misc_feature (4)..(4): n is a, c, g, or t
  misc_feature (7)..(7): n is a, c, g, or t
ggcncgngagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6085 - DNA, 2067 bp, Homo sapiens
  misc_feature (3)..(4): n is a, c, g, or t
  misc_feature (6)..(8): n is a, c, g, or t
  misc_feature (17)..(17): n is a, c, g, or t
  misc_feature (20)..(20): n is a, c, g, or t
  misc_feature (22)..(22): n is a, c, g, or t
  misc_feature (25)..(27): n is a, c, g, or t
  misc_feature (29)..(29): n is a, c, g, or t
ganncnnntgcccgggnctncnccnnnangtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6086 - DNA, 2388 bp, Homo sapiens
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggccgcggccatgacagcggctcgggactggctccttttccgcgcccctcccgccggaggtgaggggaagatgtccatgtcagggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcagttccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6087 - DNA, 2143 bp, Homo sapiens
  misc_feature (4)..(4): n is a, c, g, or t
  misc_feature (7)..(7): n is a, c, g, or t
ggcncgngagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaagacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6088 - DNA, 1993 bp, Homo sapiens
tgttttattttgcattctttacttttattatttagagtctgaagatgctcatggtaaatgcagattatagagctaactttttgcacaaaaagcccacaaaacagtctttgagagagcatgtcagtgttacgtttggattttaaaagacagtgaagcttagctgagattctgttttacagattttgcgaataaataaaaagacagattccgtttgctctggactgtgttagctgcagtgcggagggcggaaccggctgaaggaactgctgtgtattttcagcacatctcagtcagcttccgtttcagtcttctgtttccatcacccacacaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6089 - DNA, 2324 bp, Homo sapiens
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggccgcggccatgacagcggctcgggactggctccttttccgcgcccctcccgccggaggtgaggggaagatgtccatgtcagggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaattccaattgctaatccagcatttgtggatagctgcaaactgcgatattgctgatgagcgctttgacgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6090 - DNA, 2006 bp, Homo sapiens
  misc_feature (4)..(4): n is a, c, g, or t
  misc_feature (7)..(7): n is a, c, g, or t
ggcncgngagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggatgagaagaaccaagttttaaccaccaacatttggctgcaaatggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccccgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaa

SEQ ID NO: 6091 - DNA, 1012 bp, Homo sapiens
agccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggccgcggccatgacagcggctcgggactggctccttttccgcgcccctcccgccggaggtgaggggaagatgtccatgtcagggttcaaggccaaaccgaagttactggcctctatcttccaggagaaccaggagccacagccgcggctcacgccccaccgcaacattaagattacaagtggacacctgagtcagcaggacctggaatcccagatgagagagcttatctacacgactcagatcttgttgtcacccccattattgacaatccaaaggtgcagaaagcactctgacaaataatgaaacaaccaccatcggttaaatttgatgcaaaaatattgcatctaccagcattttcaggtaggatcataaaggagttatcgaacatgtagactgtctgtatacagatacgaatatgaaatttattcacaaatggaatatttgtatgtgaacaactaaatttattttgtcttgacaattggttatattcttgggtcagtgttatgtgaattgtaaataatctgtaattcatttgtgccagctgttgacatttctcagctgagtctgggctgccctgtcctcttgtgagtggggaggttcctgtagatctgggcaagttttcctgtagagtgggtggggggcctcctcccttccgttcatagagctggttgaatttccaccatttatggcaggtgtaggtgcacagggttggggacaagaaggaaggattgggattctattggcgggaccaggacatttgagaacgggactag

SEQ ID NO: 6092 - DNA, 439 bp, Homo sapiens
cctggcatttatttcccccactgacacgagaccattaaaaggtagaaatccccccctcaaaactagcatggtgatctgaacacaagaaggcacgtttcacagttactgtgtgtactgaggaataaaagaaactgatggagaagattgatcttttttaaccctctgggctccaatttttttcactttgcctgacccctctcccaagaggaatctttctcaactttttgatggattgtctcaccagacagtatatatgtgaaactgtgccaagaagtgatgggacaaacaacagggaaataaatggacgatttagctagagagaattttgttgtcagttgctagtcagagttgcagctcataggccacagttcgggtgtctgacatgcttgctgaataagtgtatgctcaataaactgcccagtagtctttagaaaaattg

SEQ ID NO: 6093 - DNA, 485 bp, Homo sapiens
tcctcaatgaatgaggacggtactgttattattcccattttacagtgaggaaattgagacacagagggcctatgtaaatagcccaaggtcaaggggctataaaatagcaagccaagcccaggacttagaactcaggctgtctggtctgagtcccagcgtctgaatcacatgcccttctatcatgttactgttgttagtgacaatctccacatgccctaaactaataccactctcctgaaagaacaaggggtagcagaactttgctgccaaaatcctgcataatcatagaaacggagtatatcatccgtgttttgacttattcagaagagaagtcatgaggaaataggaaaataataatcacatttaaaaaaattatacagatcttcattgtagagaacaggcaattttatttgaacaaaattcttctgaaactgaaacatcaagggaatgtttgaccaaataaaccattaatactttggtcctga

SEQ ID NO: 6094 - DNA, 412 bp, Homo sapiens
cacatggggtgtgtatgtatataagtgtatgtgtttttcctgctatatttatttgaggcagctgttttatagctttcagctttaaagttatagctaagtgtgtatttgtttgatagaaggctcgagaacctcttttactgccagtacacgtaaagcttggctaagcagacgcatcaggagcaaaccatttgtgttcaccaatctgtctcggcaagtcccagggccactatcttgctagaagccactgtgtgcttttgaaagcatgaaattagttttatactgagcacatggtttctcgtttagcagctctttttatggtaatggtcaatttatggttcactgccaggatttcggtgtactgtcaaagccgatagcttctgctaaggcgtctctatgaagatttaaaaaaaaa

SEQ ID NO: 6095 - DNA, 476 bp, Homo sapiens
gtttaatttacagatttctggattccccacctggacacacatgctgaatccaaaggtctgggtaggacatggtatctcaaaaaaacaaagcaaattaaagaattaaaaatgggttctgccactgcgcccggccttgagtacagaggtttgctgaggttccaatttgactgatgtggcaagactgcctcataggaggtgtagcgtcctcccgtcaggatgcgcataatgtctgattgtcacagacattatgtcacaggatgcgcataatgctgatggcagcagctgtgggtgtgcagtgcctggatccacggattcatttggggttgcaaagtgatggtattctcattctgttattccttttcatttattacatggaggagttctatgcacacaaactttccctcatctcccatttgattactcagcggtgcaatttgcaaagaaaaggaaggataaatacttgattctttccccca

SEQ ID NO: 6096 - DNA, 355 bp, Homo sapiens
ggtagcatctaccaaactctgggtgtgtgccaagcactgttctgagggcttaacgtgcatcagtactcatttaaaatcctccacacatccctataatgtaggatctactactgtccccatttgacagatgagaaaaggaaggctcagaggaggtaaccggcatggcttcttgccactgcctagcagtggaggccctcttctcaccagacagtggagcttccctgctgggtgacctcttgaactcaggcatgcctggagtttagctttggaaaggaggttgttatatgacatgttttatttagtctgcaatgtacaccagtggaggacatgaattctatacctgtaggacagtgca

SEQ ID NO: 6097 - DNA, 397 bp, Homo sapiens
tttttttttcagacagagttttgctctgtcgcccaggcagaccagttgcaccaatacaatggtgcaatcttggctcactgcaacctctgcctcctgggttcaagcgattaccctgcctcagcctcccgagtagctggaattacaggcgtctgcgaccacgcccagctcatttttgtagttttagtagagacaggatttcaccatgttggtgaggctggtcttgaactcctgacctcaggtgatccacccgcctaggcctcccaaagtgatgggattacaggtgtgagccactgcccctggccaaaattcacctattttaaacgtacaattcaatgctcttcaataaatttgttagatagtgcaaccatcaccccaatacagtactaggatattttca

SEQ ID NO: 6098 - DNA, 501 bp, Homo sapiens
atgtctgcttttcaatgcaatggcaataaccggaggttcagcagcaatctggaggccatgaggcacccctgatggtaaagagtcaatgagaggaagatgttgaggtagagggatgggcagagtgtgagtctgttcttagtgacctcagacctcactttctggacttattatatgcacaggtaaacgtctccaaagctgaagctaccataaatcagattttccatcacttgaagccaaaagcattcctaaccaacacagatagagaccccaggccgccaaagccatacttgttcatagcatcttgctgccttttactgtcaggttagagcctctctatttagatcaaagtgaaggagacagactaactccagccccttcttaccaaggcctggggaggtgagaacccggcactgagacccagcctatttcaaggcctgggccaaagtcttgccaccaactccttctgtgagtttgggggaaaattctaggactttcctgggc

SEQ ID NO: 6099 - DNA, 542 bp, Homo sapiens
  misc_feature (3)..(3): n is a, c, g, or t
  misc_feature (56)..(56): n is a, c, g, or t
  misc_feature (70)..(70): n is a, c, g, or t
aanattttgggtaaacatttttattttctcccttgttatgccagagtccagattgnaaagtcaagatatncagggttaaataaaacccaccttgatgagaatttatgatttgtagggcatgactctctaggccccttagacaggaatttgggcaagatttaacaaatcagagctgagtcctcaaaatcctattattgtttcatgaatatggtttaagaatattaattacggagggcacggtggctcatacctttcgtcccggctacttgggaggctgaggcacaagaatcgcttgaacctaggaggcagaggttacagtgagccaagatcatgctactgcactccagcctgggtgacagactgagactctgtctcaaaaaagaaaatgaaagaaaaggacaaagtaacaggaagaaaagaaaaccgtcatgtcaaagagctaatgcccttcatatatgaaaagttcttccaaattcgtaagaaaaatgttcaaaaatgatcacttcaatagaaaaataggcaaaggacatgagccaatttac

SEQ ID NO: 6100 - DNA, 481 bp, Homo sapiens
acagtgctttaagaaaaaggtaatggtcaggtgcagtggctcatgcctgtaatccctaattccagcactttgggaggctgaggcaggcagatctcttgaggttaggagttcgagaccagcctggccaacgtagtgaaacactatctctactggggaaaaaaaaaattagtcaggggtggtggctcatacctttcgtcccggctacttgggaggctgaggcacaagaatcgcttgaacctaggaggcagaggttacagtgagccaagatcatgctactgcactccagcctgggtgacagactgagactctgtctcaaaaaagaaaatgaaagaaaaggacaaagtaacaggaagaaaagaaaaccgtcatgtcaaagagctaatgcccttcatatatgaaaagttcttccaaattcgtaagaaaaatgttcaaaaatgatcacttcaatagaaaaataggcaaaggacatgagccaatttac

SEQ ID NO: 6101 - DNA, 579 bp, Homo sapiens
taggatctctcaagaaaatccatcctctgaattggggttttgtctacattcaggaggtcaggaagaactccactagccatcataagttgtcctctttaccactccgagggaactatgctagctgtcttattcctctccaaataagaaagtctgattgctatctgaggaagaagcccccatcaaatacagtttctcaaatataaattctattttagtgggcaaaggctgcttatttgagcaatcacgattaaagcaacagcatttcctggaaataaaagtgcatgcagaggtgtttggggagcccaaagcattattgacaccagccgggaaattaatctctagaggaagctcttcttcaagtgtctctgttaagggctaaacacaccctaaatgtaacttcagcatagccatgctaactgttcctcacactccctgagctaccagcctgagacaggcatcagcccagcagagcttggcattataggacatccatggaggcagggcctgactctattaggtcatctgcccaacttctccagactctgcatatttaaaacacacaaatttcctttccctcca

SEQ ID NO: 6102 - DNA, 544 bp, Homo sapiens
gtctctgggcttgagtgcaactgccaaccgtgctgggaagggctgggaggaagagccccggccccactcccctgggtcccacggggctgacacgtgccctgatgaccaggaaagcaccatgtctgggctcagcgtgggcggctggggcaccccgtcctgcccagggtgatcttgagctgtccctctgtgtccttcagcagagtgagtggctgagcgtccaggctgcgcgatgagcacacactactactgatggcctttcgggggtccctgccccagccggagaggccggtgcacagggccccgccaggggctgggggcatcccggcttccacaatgcagctgctctgggcctcgggagaggagagaccccagtcccctgggctcgcttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttgactggtccac

SEQ ID NO: 6103 - DNA, 694 bp, Homo sapiens
ttgcccccactccccaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagcggccgtggggtgcagcctcagcaatggcggagcagagtgagtggctgagcgtccaggctgcgcgatgagcacacactactactgatggcctttcgggggtccctgccccagccggagaggccggtgcacagggccccgccaggggctgggggcatcccggcttccacaatgcagctgctctgggcctcgggagaggagagaccccagtcccctgggctcgcttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttgactggtccac

SEQ ID NO: 6104 - DNA, 651 bp, Homo sapiens
ttgcccccactccccaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagcggcaactggcgttcacatcgagcggccgtggggtgcagcctcagcaatggcggagcagagtgagtggctgagcgtccaggctgcgcgatgagcacacactactactgatggcctttcgggggtccctgccccagccggagaggccggtgcacagggccccgccaggggctgggggcatcccggcttccacaatgcagctgctctgggcctcgggagaggagagaccccagtcccctgggctcgcttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttgactggtccac

SEQ ID NO: 6105 - DNA, 2753 bp, Homo sapiens
cctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaatttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagctttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaa

SEQ ID NO: 6106 - DNA, 2699 bp, Homo sapiens
cctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaatttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagctttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaa

SEQ ID NO: 6107 - DNA, 2597 bp, Homo sapiens
cctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaatttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagctttttttttttttttttttttcaatataaagtgttttctttaaaagtcatattggttcgtggcctagtgccttggattttacatatttttctttttaaatgcaaaaccttttcaggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaa

SEQ ID NO: 6108 - DNA, 2487 bp, Homo sapiens
cctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaatttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttatttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagctttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaaacacttaggagttaaagcaattcaagggtcgagc

SEQ ID NO: 6109 - DNA, 435 bp, Homo sapiens
gcttagtggataatcccttagcctccaggcagaaaatgcaacttccacattactctggctgagtctctcggcagccgttctcagccagtggctaagactgcttaggagatttgactatattttttctgcatcaactataaaaagcagatgtcttacaattacatagacatagcttctgaagagataagtaaaactatcatttaataataagtgaatgaccgaggcaggcggatcacgaggtcaagagatcgagaccatcctggccaacgtagtgaaaccccatctctactaaaaatacgaaaattagctgggcgtggtggcgcacgcctatagtcccagatactcgggagactgaggcaggagaattgcttgaacctgggagatggaggttgcagtaagccaagattgcaccactgcactccagcctggcaacag

SEQ ID NO: 6110 - DNA, 381 bp, Homo sapiens
ctgagcaacatagtgagactccatttctgtaaaaataaaaaataaaaaaaaatcagcccaggcatggcggtgcatgcctgtagccccgagctattgattattgtgaataaaggcaatataaatattcacatacagctttttgtgtgaatataaacctctatttcacttaggtaaatacctagaagtaagagtgctatgtcatatggtaagtttagctttatcaaaaactggtagccagacacagtggcttgcccctgtaatcccagctactgaggaggctgaggtgggaggatggcttgagcccagaagttggaggctaccatgagctatgatcatgaccctgtactccagcctgggtgacagggtgagatcctgtctcta

SEQ ID NO: 6111 - DNA, 410 bp, Homo sapiens
taacaccatccccccttggtgctgtcttcaggatagtgaattctcatgatatctagttgtataaaagtgtatggcctctcccacctctctctcttcctcctgttccagccatgtgaagtgctggtttcccctttgccttccaccttgattgtaagttccctgaggcctccccagaagctgatgctgccatgcttcctatacagcctacagaaccatgagccaattaaacctcttttctttataaattacccagactcaggtatttctttatagaagtgcaagaatggactagtacgggtgtctacatgagaaattactctttctgttttattacatctttctttctcaggttttgtccttcacctaaaagtaattaaagctgattagtttcaaaataaattatgtacttg

SEQ ID NO: 6112 - DNA, 475 bp, Homo sapiens
attgtcacaaaatatgaaaaccacatctgtaattgttctcagaactgcttagcaacctcagctttaattgtcagccagcttatcagaacatgcagttaattatcgtgtctcatacctagaatgttcggcatgtgaaagagttctggagatggatcttccctgcagtgaaattgagtcagatggatcacctgcaggggagttcaccctgggagaatatttcagaatttgcctgcttcttcctggaaccagcctctgttagaatgcatgattccgtgatgaaaacttacagattttccatggaggagaagacctcttcctgatcatatgtccattgttatgggactgtctattagtggtacagttgctgagccagcccaggtttagtattctcattaataacaggtatttggatgctcttaacagttctaggggaaatttatgagtgatgaggtaaaataaaatgctggatctgaga

SEQ ID NO: 6113 - DNA, 424 bp, Homo sapiens
aacatagactgtgggaaaatatataagataaacaacccaatttcttcaaaagaaattttgtaatgaatgaaaaaggaaagatggaaggagaacctgtagtttagagactcaagagatatatctacaatcataatgtataagccaggcacggtggctcacgcctgtaatcccagcactttgggaggccgaggcagacagatgacttgcggtcaggaaattccagaccagccagggcaacatagtgaaaccccatctctaccagaagtataaaaattggccgggtgtggtggtgcacgcctgtagtcctaaggcaggaggctaaggcaggagaacagcttgaacctgggaggcagaggttgcagtgagccaagatcacgtaactgcactccggcctgggtgacagagtgaagaccctgtctcaaaa

SEQ ID NO: 6114 - DNA, 509 bp, Homo sapiens
attcaagatagcgtcgacgtcctagccagagcaattagacaagaaaataaaaggcatccacattggatagggagtaaaattatattttttcaccaatgacatgatcttatagcgattctataaaaacagaataattaacaaattcagcaaagttgtcaaatacaaaatcaacacacagaaatcagttgcatttctatatagtactagcagtgaacacttcatgaaggaaattagcagtttcatttaaatagcatcaaaaagaataaaatacataggaattaaccaaggaggtgaaagacttgtacacagaaaactacaaaatattgttgaaagaaattaaagaagacataattaaatggaaagacatcctgtgttcaattatatccatttaaagacacaattaaatggaaagacatcctgtgttggaaagtttaatattgttcacatgtcagtactacccaaagtggtcatcagaggcaatgcaatcctattaacatcccaacagtgtt

SEQ ID NO: 6115 - DNA, 190 bp, Homo sapiens
cctggaagtttaggaatgcaaatccgtgtctcccagcccagacctaatgagtcacaaactctggctggagcacgaagtatgtgtttgaataaattctccaggtgattttgatgcacgcagcatgctaacatttaagaaatcctggtctataatgtttcacttatgccaaactaagacattttacagaggg

SEQ ID NO: 6116 - DNA, 1214 bp, Homo sapiens
atattcatcagtaagagtataaaaacacatgagaatggccgacttcaacttgatgacagtggtaacttctggaaagggaaggagatgagtgcaaaatgggaaggacttacatggaggatttcagctatatcagtaatactttattcttgggggaaaaacaggcaactaaggtaaaatgttatggttttatatgagggtgaatataggtttttaattatttttttataaattgtgtgtttagaatgatttataattttttaattctacaaattaagtacataaatgtttggctgctagcttggctagttcagacttggcttaattttatgtggatttttcacctactctttaaaatatattctaattgtttttcattacttagctaagaaacaacattttaaagtaacttttaggcaagatggcagaggcagaaaggggaaagttccaaaagaaaagatttcaaacatgctgaatggatctgtgtcacagatcatgataaacaaaagcctgctatgtggtgagtggttcaggccaaagcctatggatttgggaaatactagctgggtagaggccagagtcatgagagtaggaagctgtcctgggaaaatgagtaagagtagggatttcaacttgggtggcggaagcaagaagagaaacttcttttggggtgtctcacaattacctaggaacaattttaaactaggcataacctaccaccaacctaccccccaccgttaagaatcactacccctataagcagtgaatgttgagttaaaataagcttgcaaaccatttgtctctagaaaaaaagatcaaagggcttagaacttatacccacattttggggataggaagaagagatggaaaagaacttgatagaaggctgttggaagtgatggacaagcaaaggagtaatactaacatgaggccgaataacataaacccactaacagagcggcaaggctgctacctcagactgtgaaaggagttaggcagaaaaggctgaaaaaagatacgaagggtttcataggtaaagaagtaagggaagaaaactcaagcttgaaagaatatcataacacagtggggtttagggctgggtgaccctcccaacaccccagcaaggaccatatcctacagccaccacatgaggtaccagtgacatggggctcatttctaattaacatgctccagaatcttgcaaaaaggtttttgaa

SEQ ID NO: 6117 - DNA, 152 bp, Homo sapiens
ttaggatgagttcttgggggcctgcaaattaaataaacaagagacgtggccaggtgcctaactcttttgagaggccagggtggaaagatcgcttgagcccaggagtttgagaccagcttgggcaacataaacgggaccccaatctctacgga

SEQ ID NO: 6118 - DNA, 516 bp, Homo sapiens
gctctccttagctgccacgtgctgcttgcctttctgtttatgtttctgccaggcttttcagcatctacccctatactgctcaagagctggcaaataacccaagggagaagaccagaatgctaagtgtcaggttacctccatgaagtcctttctccggatttttggcacttcaagttacttgtgccaaggcagctcttgaatgtcttagaacagatgaagtaacttaccagcttttctcctcctcttggcagggacattggtttcctaaaagttgctcagttttggccggaagtggaggtctaaagtttttggttttgttttcctgaattatctgtgttgattttggaatcagagtttgcaagccacaaaatagattgatagattcctatatttttctataatgtaaaatgagttgagcagcttttacattatcttttgaaagtttgaagtaactttttttttttaagatggaatcccactgccctccagcctgagcgacagtgtggactcagtcac

SEQ ID NO: 6119 - DNA, 277 bp, Homo sapiens
ttggccctgatctgccagtcagtgtaggtcacagcaagtcagcagcaggctaagctgtgctgagtgtgtgagaaatgggagcaaagtcatatgttcaaaaatgtgcaagacttggcatctccaccacagttttctttcacctttgaaatatgggaaggttagaaatggagtggaaaaatatcagcccagtctagttttgaaagattgagtttttttaggaagaagcaagcttgttatcatttttaaataagacaaaacatgaccttgaattagatta

SEQ ID NO: 6120 - DNA, 287 bp, Homo sapiens
gaataggaataattccacaccggcagtgtcagccttgggattccaaccttcaccgcctgctcccgctgccgcagtgcctccagggccctaccgcagtgaaatgtgaaattcaatctaaccctgacggaggtgcaagcaggcgcttgacattttcagagttctacaaaagggtttcgccccttcctgtttttgaggatgacatttttgtcaggctctacctgccccatgtctcagttgccagtgagttcctggagctcggttaacaggatggcagctcccctggtgac

SEQ ID NO: 6121 - DNA, 873 bp, Homo sapiens
ggctgcctactcaagtataacagaaaaaaattctgggtctggtagccagaaacctgatttgaatcaccacagcagagagtcacggcctctcccctagctcttaggactgagtcagttcacagccccagggcccctttatgaactggggtgtgagggtgtggggggatttcccccaaagaatgaactctgcagccctgctgcaagtacctactgtaagtctccctctaggccctactcagaagacctgtgctatttacagagtgactgtgcactggggaaagcaaactacccaggccttctgagatgactgaagcattggctctgaattgatgttcatgcacggggacccaaagtgacagcgtggccactagtcaaaatgggagattaatggtggttaggtgacagataccttactaaaagttttttttgttgttttgttttgttttcctaatctggatgcgtactcaattagggaaaaaaaaaaaagaaaaacagtttttttgtccattgagttattttttctcctttaatatgttaataaagtagaatacattgagagagttgctgatttgagtcatctttaaattcctgggataaaccctactaggtcataacgtgtttggccagcaggaatcctcctgcgcggtctcagtaaaacgtgtgggtggacaagtgcggccgggtgtcccacccacataccgctggcagccgcactctggtgaccggacagtgagacgccctcctgtcgtgtgcctccagcgccctctactgacacagcttagcattttgtcagctggcaagaaaaacgttcacagcaagcatccactttcacaaagcaaagaggtggatttggagctgacaggcagtaaattg

SEQ ID NO: 6122 - DNA, 202 bp, Homo sapiens
aggatcacttgagcccagcagtttgagaacagcctgaacaacatgccaagaccccatgtctatgaaaaataaaaaattagccaggtacagtggcatatgcctgtagtcccaactattttggaggttgatgcaggagggtcacttgagcacagttggttgaggctgcagcagggagccatgttcgtaccactgcactccagcc

SEQ ID NO: 6123 - DNA, 424 bp, Homo sapiens
ccagtaggtgacttcctttgcattttaaacattctgaacaagtcagtgatattatgcaatttgctaccattactgaaagtaggtaattagcagtgttattatgtgtttcagatgttattaaaaaggctataaacaaaatgtactttgtagaatctttgacatgaaagacagataggaggagacaagtcatgtttcgagataactaagaaagtaagtgatgtggattacatactggagttgacaacttgtgaagctagacattattaataattaaaagttatgaccggtcatgtactggacaaccaacagtaattaatttctaacgactgtgtgccgaatgagaatggggaggaaattaacagtatttcttcatgaagtgtgttcttattagctgagatgctttaaatgtagcaggttgtatcat

SEQ ID NO: 6124 - DNA, 471 bp, Homo sapiens
acactgtgtctacacgcggagggtacagcggtgaacaaaacagacaatgcccctgacttcacagggcttacattctacttggggagacaatgaaaacactaaatatgtgattagccatgtgctgacaagtgctttggagaaaaatattgcagggtgagggggcagggagtgcgggggaggcctggctgataaggtggcattccagccaagacctcgagtcgtgaggttgcaggccacggatctggagaaggaagcctctcgacagcagaaactggaggcggcacaggccccttttgttttatctgtgcctgctttgaagaagtggatgtgctcttggaaaattctgtgtgctaatcaaatatttgtaaatcaaatcatattttaaatgcatcaaagaaacttccatttaaagtgaccctggagtaaatgagtctgcaaagtaaataaaatgttctgatgtgaataatttat

SEQ ID NO: 6125 - DNA, 1243 bp, Homo sapiens
ggtttgctgcacccattaactcgtcatttacattaggtatttctcctaatgctatccctcccccagccctcaccccatgacaggccctggtgtgtgatgttccccgtcctgtgtccaagtgttctcattgttcagttcccacccatgagtgagaacatgctcgcaccgccgcttctaaatgttttaaaaacaaagacaccaatgcccttcattggggaaatgaaagacttttaagtaaaacgattttgagtgaaataatatttgttgttttaaaaagttaatattaaccactctccatcatatgttgaaattatcttaagatgtgaaagttaaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttatgatatcactacacacctggcatagtttaaaagactgaaaatattagtgtgtgggaatgtagagcaactggaaatggcctacatctttcatagaaatgtaaagcaatacaaatactttgcaaaactctgtccaacattttctacccattcaccaagcaactccatccctagctatagatacccaggaaaataagtatgtatcttcacagaaataattgtatgagaatattcatagttacttatgcacagtagttatcaagtaaacctgtctcccatcagaaaaatggatataaaattgtgtgataagtgcagtacaaggcaactatggatagttaacattaggccagaaacacacacactgttatcaaggagaaaaaacacaatacaaaacaaaataagatggcaaaaataacgcacgcgcggatgatacgcggatgtcgtgcagtgcccaaggctagctcaggcgacgttgtaagtgccacgagagacattagcgagaaccgagggcaggcaaaacccgacgggcgagcaga

SEQ ID NO: 6126 - DNA, 1245 bp, Homo sapiens
ggtttgctgcacccattaactcgtcatttacattaggtatttctcctaatgctatccctcccccagccctcaccccatgacaggccctggtgtgtgatgttccccgtcctgtgtccaagtgttctcattgttcagttcccacccatgagtgagaacatgctcgcaccgccgcttctaaatgttttaaaaacaaagacaccaatgcccttcattggggaaatgaaagacttttaagtaaaacgattttgagtgaaataatatttgttgttttaaaaagttaatattaaccactctccatcatatgttgaaattatcttaagatgtgaaagttaaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttatgatatcactacacacctggcatagtttaaaagactgaaaatattagtgtgtgggaatgtagagcaactggaaatggcctacatctttcatagaaatgtaaagcaatacaaatactttgcaaaactctgtccaacattttctacccattcaccaagcaactccatccctagctatagatacccaggaaaataagtatgtatcttcacagaaataattgtatgagaatattcatagttacttatgcacagtagttatcaagtaaacctgtctcccatcagaaaaatggatataaaattgtgtgataatcatacaatcaataggatattacttggccaaaacaaaatgaaacaagggaaaaacacaatcaaacaaattagtggcatatatacccacctgagtaaagagaagtcggccgggcgcgggtgtcacgcctgtaatcccagtactttgggagccgaggcggcagatcacgaggtcaggagatcgagaccatcgtggctaacacagtgaaaccccgtctctactaaaaataca

SEQ ID NO: 6127 - DNA, 415 bp, Homo sapiens
cactctaagtttgaatagtagaatttcttatcttttgaccaagatgtgttacataaacttgggttagcataaaaaaacaaaaattttttaaaccctcatgtgtcttaaagataatagtagactagaaatattaagagctgaaccaagagttttaatgtatggtaatttgaaataattttaatttactgataattttattttaccagtatattacaagttgagttgactgaaaggatagtttcaaacccaaagctgtaatatcagtttcaaggagcatcaattaaacagcttggacttatgattcctacaagtgccataataatctgtgaaagcctattgtatacaatctttaataattggttgctgtaattaacctcagaaataaaagcagcttcactgaaggcataatattata

SEQ ID NO: 6128 - DNA, 454 bp, Homo sapiens
ggccgcctgcctctccgcagccttgggctacctggacgtgcgcatcgtggacacagactacagctccttcgccgtcctttacatctacaaggagctggagggggccctcagcaccatggtgcagctctacagccggacccaggatgtgagtccccaggctctgaagtccttccaggacttctacccgaccctggggctccccaaggacatgatggtcatgctgccccagtcagatgcatgcaaccctgagagcaaggaggcgccctgacacctccggagccccacccccgcccttcccaggtggagccaaagcagcaggcgcctttgcccctggagtcaagacccacagccctcggggaccacctggagtctctccatcctccaccccccgcctgtgggatgccttgtgggacgtctctttctattcaataaacagatgctgcagcctcatggc

SEQ ID NO: 6129 - DNA, 293 bp, Homo sapiens
atcctgaccctgctctgggcgcccacggctcaggctgaggttctgctgcagcctgacttcaatgctgaaaagggtcttcctgggcaagaaggaccacctgtccatgtccaccagggccatcaggcccacagaggagggcggcctccacgtccacatggagttcccgggggcggacggctgtaaccaggtggatgccgagtacctggagtctctccatcctccaccccccgcctgtgggatgccttgtgggacgtctctttctattcaataaacagatgctgcagcctcatggc

SEQ ID NO: 6130 - DNA, 1993 bp, Homo sapiens
cttttcttaaattcctcattaaatatgaacctaaggcatacccatcatttaccttgattcccatataatttgtataagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactaggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttgaaaaaaaaaa

SEQ ID NO: 6131 - DNA, 1959 bp, Homo sapiens
cttttcttaaattcctcattaaatatgaacctaaggcatacccatcatttaccttgattcccatataatttgtataagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcaacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactaggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttgaaaaaaaaaa

SEQ ID NO: 6132 - DNA, 578 bp, Homo sapiens
tccgtgacgtcaaggcaagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaatttcataacacaaaggctggtttttggcttgaaataatcaggcaaatatataatgttctgtcacccaggctgaagtgcagtggcacaatcttgctcactgcaagctccacctcccaggttcacgccattctcctgcctcagcctcctgagtatctgggactacaggcacccgccaccacagcttttttttttttttttttttttgagacagagtctcgctctgtcgcccaggctggagtgcagtggcgcgatctcagctcactgcaagctccgcctcctgggttcacgccattctcctgcttcagcct

SEQ ID NO: 6133 - DNA, 528 bp, Homo sapiens
tccgtgacgtcaaggcaagtacattgattgaagtaacatgagagagaaggggtgggtgtagcaaaaacattctcaaggccaagtcatcagcccttacccttaggagggggcagtgattaagaggtggtatgagagcctcgtttctcatttctataagtgctggtaaaggacctgaccccacttccttacctactgcctgcccaggtaactgatgcctacagcatcacaggaattgccaaaatgcagaaaacaaatcctaaattgctctaatttcataacacaaaggctggtttttggcttgaaataatcaggcaaatatataatgttctgtcacccaggctgaagtgcagtggcacaatcttggcttactacagcctcaacctcctgcactcaagcaatcctccaacctcctgagtagctgagactatatgcacatgccactatatctggttaaattttttattttctgtaaaaacgaggtcttaccatgttgcccaagctggtctcaaactcctcgcctcaagtgat

SEQ ID NO: 6134 - DNA, 472 bp, Homo sapiens
gggaagatcacttgagcctaggagtttgaggctgcagtgagctatgattgtgccactgcactccagcctgggtgacagagtgagactctgtctctgaaaaaataagtaaacaaaagataaatgaaaatatttaaggctttataagaaactagattttactgaatactgaggaagataatccacatggagcgaggaagaaaaatatttgttgactgtccactctgtgcttttactctcagactgaccgtagaagcagacatgtgctagttgcctgcctagttacttttcccttcctctagttgttgactggtatttctacaggaaattcacctcagccatgaggtttgagaagattattcccctcaggttcagggtaactcttgattggcttgcacttgcctcttccccctggccacagtgatgagtcatggatgggcacacaacccaattcaggccaatgagagagagagag

SEQ ID NO: 6135 - DNA, 337 bp, Homo sapiens
ggtacaagaaaattgaatctcatgataaatattcttctgtaccagtgctcactcctctcttagttactttaaaaaatcattagcaaacatttccatctctagaagtctgaaggaaggagcaagggctttagaatgacttgcattcagttcagaaccatgccctgccacttattaggtgttttaaatttgggcaagttacttaatatcttgacttcagttgcctcatccataaaaaagaaaacattgttagtaggactaaaaacaacttgaagaattcattatgttgcataaggtgtttataaatgtccattattattaccatcaaaattaaaagtgg

SEQ ID NO: 6136 - DNA, 293 bp, Homo sapiens
ctccctgatcagcctttgtaatataagtaagcctattgtttaatctttcatttaaagtgtgttcagtgttttctatgggacgaacatacttatgacttacattttgaagttgatttcatccttttagattctaaatgccttgaaagtgagtgctttaaaagtaagaatagcataagttgtttatatgtatccataaaatcctagttggtaacacagagtttttataaggagtaaaggggtctcaaatccctttgggttggaatcatttgttactttgagttttccttagcagg

SEQ ID NO: 6137 - DNA, 380 bp, Homo sapiens
tttttttatttttgagacagagtctactctgttgcccagggttgggggtggtggggaagagagagaaggcacaatgaaaacatggttttgtaatcttaagggactgctctgacatatgcagtctgttgttgaacggaattgttaatgcagctcatgaccgtaatcaagcatgcataatgtttcccttttctccattatttataaaatgctattaaatatggcaaccaaatctagccagaattgtaaagggtcttgaagtgcttatcatactaattaaaaaatgaaacacaaattacttttgaaaaggattcaaaagtatctttttgagcggagatcgcaccattgcactccagcctgggcagcaagagtgaaactccatc

SEQ ID NO: 6138 - DNA, 573 bp, Homo sapiens
gtttcagtaagccgagatcgtgccactgcactctagcttgggctacagagtgagactccatctcacacacacacacacaaaagaaatgaaaacaacaatttgtacatgagttcaaaacagaattatttatttcccaaactagaaacaatccaaatgtctatcaacagataaatggataagcaaatgatgacacaattgcattaatggaataccactcagcaatgaaaaggaacaaaccactcatacctacaacacagatgagcctcagaaacgtgatgctaagtgaaagaagccagaccaaaaaaattatatgctattattccatttctatgaaatttctggaaaaggcaaaaaccatgcaaagtagatcagaggttggctgggggtgagagcagagactgactacaaataggcccaagggaacgttttggggtgatggaagttttctataagtggattatggtgatggctacacaacagtataaattaaaggtcatccaaatgtgtacttacaatgtttgaattgtatgacatgtaaattatctcattaaatctgtattttaaaaaaagaac

SEQ ID NO: 6139 - DNA, 202 bp, Homo sapiens
ttaatatgggctaaattgtccttaagttcctgattgtaaaaatcatgtggaaaaagtactttgatcatgcttttgttggactataaaccttctttgaaagcagatttcagcaatttcattatgtaattcattgttgttggttttgtttgaaagattattacttatagaaagaaagactgtaaaatcttagcactatcttgca

SEQ ID NO: 6140 - DNA, 383 bp, Homo sapiens
tcgacggttcacgctattctccttcttcagcctcccgattagctgggactacaggcggcggagcttgcagtgagccgagatcgcaccactgcactccagcctgggcgacagagcgagagtctcgaaaaaacaaaaacaaaacaaaaaaacaaaaacaaacagccagtacctacaaggcagagtttatatttcactcttagttttgagaggcagaatagtaggaagaacatggactccagactgattgcctgagttcaaatctcagctccaccacttacgagctgtgggaccctgagcaaattacttaaattttcagtgtctcggtgaaacacggaaaatagtacctctttctcttggtataaccaccagggatgtggtcgacc

SEQ ID NO: 6141 - DNA, 461 bp, Homo sapiens
tacatagtgaataaaacccagtatgatagcaaagggtctctcttacgaaaatataacacaatattactttttttgtatgaaaataagtttctatcttggatagccaaggccttaacaggtaacattataagagtactataaacaaatttaaaacccaaatgttttgtgataagtcagggcttctacctcctgtgaactctgggcattttgcaaatttgaataatcagtcatctcgagtctcctctttttacagatgagagtattgaggctcagatgggacacaggttttcttctgggtcaccaaactcaacagcagagctgagtttggggcccttgggcctctagggagatctagcttttctgtctgatacgggaactcctaagagcacctccatccaccccagccagctttcctttcttctggtcatttctctttaacagttgttgctcctgcactcatc

SEQ ID NO: 6142 - DNA, 436 bp, Homo sapiens
  misc_feature (393)..(393): n is a, c, g, or t
gacgcgtctgatctcgattagtcctttcccttttgactcgtagtcagcgcgtggtagcacatatctctattccaagctactaaagaggctgaggcgagatggggagcgggttacatgagcccaggagttctaggccatagtgtgcaatgaagatgcctgtgaataaccactgtactctaccctgggcaacacagcaagaccctatctcttaacaaaaaaatgatggtacagttttggatgtgcagacacatgtcaatacattcttgccccttgcaatcctaggaaaatgctgtcctggcttttccttcccctgaccttgtgccatttcatgccagcttgggcaacaggagcgaaactccatctcaaaaaaaataataataaaataaaaaaaancccacccacagtctcttctctcctatttgaaacacaggactcg

SEQ ID NO: 6143 - DNA, 631 bp, Homo sapiens
gacgcgtctgatctcgattagtcctttcccttttgactcgtagtcagcgcgtggtagcacatatctctattccaagctactaaagaggctgaggcgagatggggagcgggttacatgagcccaggagttctaggccatagtgtgcaatgaagatgcctgtgaataaccactgtactctaccctgggcaacacagcaagaccctatctcttaacaaaaaaatgatggtacagttttggatgtgcagacacatgtcaatacattcttgccccttgcaatcctaggaaaatgctgtcctggcttttccttcccctgaccttgtgcatatttccatagcactgggaaatctaatttctctttcctccttcactcatcttgacccaggagtggtaacttggaaatggccatgtcagagaaacaggcttaccaatatggggcatatcttgctctagcaccctccacttaatggctgttttgctccaccacttggctttgtaagagtcttactgctcattgggcaggcgtggtggctcacgcctgtaatctcagcacctggggaggccgaggcgggcagatcatgaggtcaggagattgagatcatcctggctaacacggtaaaaccccgtctctact

SEQ ID NO: 6144 - DNA, 781 bp, Homo sapiens
agaattgcttgaacctgggaggcggagattgcagtgagccgagattgtgccactgcactccaccccgggcaacagaatgggactccatctcaaaaaaaaaaaaattaaacttctgtgcatcaaaggacactattaccgtgaaaagtcagtccacagaatcagagaaaatatttgcaaatcatgtatctaataagagattaatatccagaatgtataaactcaataaaaagtaaacaacccagtcaaaaaatgggcaaaggacttaaatagacatttctccaaagaagatatacaattggccagcaaacacaagatgctcaacatcactattcattaggaaaatggaagtgaaaaccacaatgagataccacttcattttcattagaatggctattatcaaaaacaaaaacagaaaataacatgttggcaacgatgggagaagttgtaaattgctggtgagaatgtaaaatgctgtagccactgtagaacacagtatggcagtttctcaaaaaaatgaaaaatagaattactgtaagatccagcaattccacttggacatatacccaaaataattgaaagaaggatttcaaagatatttgtacaccatgttcatggcagcattattcataatagtccaaagacagaaacaacctaaatgcccatcatcacatgaatggacaaacaaaatgtatacacacacaatggaaaactattcaactgtaaagaggaaaattttgttgcatgctacaacatggatgaatcttgaaaaagttatgctaag

SEQ ID NO: 6145 - DNA, 777 bp, Homo sapiens
gatgcataagaagattgtgaggcactgctgagccccttcccttcaagggttgtggtcagaaatccaagccaacgctgtcagctcagttgtctgatattctccagcagtgttcagctgtgtgggcaccaggaagaaaagctgcagcatggattcacaagggccaaggttttacacagcaagtaccactggactttagaaaagggggcaagccagggagatgagggtgttttcaaagggatgattatttaagcctggcagaatatttatcaaatgcatgatctgctcctagtgaatgtatttagtaaagcacacatttccaggtctgtgtatctacatatttctgtatacattcttatagatacggtttaatgccatggtttcattcaggcttattttctaaagccttttggttttggtttttgggaagcctactctatttcccccccctggaactaatgagcgagcaagcaagaggttctgtaagcaaaagtaaaagctgcagactttgttatggttggacctgtgtgtggaaattctgtgaattgtgttctgtcagcatcctgctcacggaataggctatgtaaacaacgggcgctgggagggtctgtgaatgagcagccttccttcccactcacagacttaaccactgcaattctccaggtttctgagtgtttatttcatagtaaaaagggctctaaaaataccagggcagttaggtttttattgtagatcatttcacttaaactgcaatgggacatataaattttaaaaaaaaaa

SEQ ID NO: 6146 - DNA, 2390 bp, Homo sapiens
tattaaggcagtgtttcctaaatgtatttgacctcagtagcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttgggcaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgatgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagaagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacacttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatca

SEQ ID NO: 6147 - DNA, 2589 bp, Homo sapiens
tattaaggcagtgtttcctaaatgtatttgacctcagtagcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttgggcaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgatgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagaagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacacttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtccaacaccacctctcttggacaaaaaataaaacaagcaacagccatcagatgagtgaatagatttgaatgatttttcccacagggaatcagcctcaaatgttcatgtttcaccccgtcccctttaaataaaaagaatctctgtgttctctttgggcaaaatgtaaaacagggatatcatcttcaggaacctgtcacatttttccatctggtacctccaccctattctgagtatcctcccctttccac

SEQ ID NO: 6148 - DNA, 2595 bp, Homo sapiens
tattaaggcagtgtttcctaaatgtatttgacctcagtagcctttctatttacatcccacagaactggtgactatgaaacactctggtgaacactgggttagagagtaacaaggaaacaagagatagtgatcaggcatccagagcccccttttttatccatatgaaagccaggggggccagaccttgttcatgtgtgggtctgtcttccttatgccaatcagcagtatatacatcacctctcaccctcacctgctgaaaaaataacctttttacccattattcctactcccttcatcctgcacatacatatatccagctgagagatcacactacaaggctaagagatgatctaatacccccaaatagccctggcccacacagaaaaacagaaaaacaaaaaaaactttatccccttgaacagtcccctctctcctcttgactgtctttatgtgtctgtgtatttgtgtgcagggtctttgaagacagcatgctatgtgcaaactgtacaagctaggttttctaggggctgtgttctggggatgagggtagtggggattatatggggttttttctttgtttcaagacaggaagcagtctggttaagggagaactagtggaaagggttaaatgacaggttaagttgagtacaaagctttcccagtactgctgagattaagacaattgtggatgtgtatgtctaggtttgaatctctgggctgcagattgcttttgccctggcagagaaagaggagtctttgggcaggtgagctgtttcttgttgatttcaggcaagaggcacatagaaactttgtattgagtggggattttgttttaagtgctggaaaattagggcaggaattacgtgtttgcaagttgttgccatcactggtttgaatttgactgcctcatcaaggggcaagagttattcttgaagatctcattctcccagaaacagaactttagggaaaatggctgtggcttagcttttcagctgatgcagggtaataagctttctggttggttttccttccaattctggaaaggtgtccacactaagacccttaactctagggcttgcataagtattctagcatcgttagctaatgagttggtcattgtttctctttatcaataattgtgttaataccaatcttataatttaaaaattatcttgtatgtaagagaagttcggggttagggaggaagaggagcaaagtgggatattttctctttaatgcttagatactgtttcttccctaagatgtgtttctcaaccacaattggtggaatgaaccagagaggcaagaggaagtgaattgcaccaatttagtttagcgactgtgccttttgcaggaaaaactgggtgaatcacagctcctcagagtcctggactcaactagaattgaagatagacttattttgctgactgggcttcttagagtttatgtgacttgaacagcttggcccctgcctcccttctgctactgtgagcagccttccttcttccttcattcttcctggaatgcagttctcttgcttatgatcctatgaataaggcaaaatggctggtctttgtaaggcaggtcttgccctagcttctcagaaacaggagcattttaggatcagtattaggagatgccccagggagtaagaaagtattgggttcagtgataaatctggactctgacacttcttttactctccctctttaatactaaaagctctgcataagcaatggttcagaacctgtcttgggtacagacctgttgaatctgacagaaaccagaaacgcacttttgagaaaaagacatttgtaattcactcagttttccatacacatttagcaggttcaaagcccatctgtggaatccctaaactgccttcaaagaaagggagttccccgatctaaaatggtcattatatatttgtgtcaagaattagaaggcaagggtcactaaatattttaaggattaaggtaccagaggcatcagtggtataaggatggagtctggtctttaattacgacaagggtattgcttacattctactctctggttttcaaaaagatctgacatgctgacaaatccagctcctcacaaatcttgtttgaaggacttgtgggaagtgatattccttactattagatcacgccccttataactacatgttaacatccagccttttatctgtttgagtaattgtagggatagaaagtgaagcccccagagttaggtgcaagtatagcacccagctgaaaggcatcatggagtctaagggccttctacagaaggggcaatcctttgggttatttctggtgtaccactgtcttctctacctcggtgctataacgaaatggcaacagtacagacaataaaaagatcaatggctgctagaagttgttagggaggagggggaagggacagagggaagaataaaacatgagattttcaggtcagtgaagctactctgtatgatactgtactggtggatatatatcattatatatttgccaaaatcaatggaatgtacaacatgaagagcgaaccttaatgtaaactatggactttaattaataataatgtatcaacagtgct

SEQ ID NO: 6149 - DNA, 4758 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcaggtaactgcaatatttccatagccaggacccacagggatgggtacaagagctgggagatgttgtaagaaacactaaggcaggacagcagggtggaaaggtgagggcaattaaggaattatgagaagacagtgtatttggtgctaaaatgtgttcctatttgttttgttttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6150 - DNA, 2311 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6151 - DNA, 2602 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6152 - DNA, 1411 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6153 - DNA, 1120 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctggggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6154 - DNA, 5049 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6155 - DNA, 4975 bp, Homo sapiens
gggggataggctcagacacaaggagaggcttggagagagcagacgccttctggattcaagaagacgagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6156 - DNA, 4995 bp, Homo sapiens
ggcgtgtaaaggggtggggtcgtagaactgactctctcggaggcaaaaggagctgggccttggaaaccagatggcctgggttttttagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6157 - DNA, 3808 bp, Homo sapiens
agggactttctgtctggagcaggcaaggtgaggagacagagccatctctttcacctggtgactctggaccttccttctttctgatgatgaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6158 - DNA, 4569 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6159 - DNA, 5028 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6160 - DNA, 3246 bp, Homo sapiens
gttggattaaaaaacaaatttattttctcatagttcttgagggcgagaatcctaggtcagggtccacgagggtcagttcctgttgaaggctctcttcctggcttgcagatggctgccttcttgctgtgtcctcacatggctttgtgtgtgagagagaagagagcaagctttctggtgtctcttcttataaggacactaatcctgttgatcaggaccccacccttatggcctcatttaaccttaattatctccataaaggccctatctccaagtacaatcacactgggtgttagggattcaacatacgaatttgggggcgggcacaacccttcagttcataacatatttacgctctatcatttcctgtaattataaagacacttaggctaagtgaggttaagtaacttgtccaaggtcatatagcacgtaagtcagcagagctgaaactggagttcagaactgacccatgatagagccccaataactgagaagtttaaaaaagtattgctactagtttaatacaaagcccgtaggttaatacatgattactagggttgttttcttattatgattatcatccccatttcaggtgcagaagaaagaccccaaggactgggctgtgcagtaccgcgaggcagtggagatggaagtccaagctgcagctgtggctgtggctgaggctgaagccagggctgaggcaagagcccaaatggggattggagaggaagctgtggctgggccctggaattgggatgacatggatatcgactgcctaacaagggaagagttaggcgatgatgctcaggcctggagcagattttcatttgaaattgaggccagagcccaagaaaatgcagatgccagcaccaacgtcaacttcagcagaggagctagtaccagggctggcttcagcgatggtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggggcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6161 - DNA, 3019 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggccattttacaagaaagggctaataagttggtgaaatacctgttggttaaggaccagacaaagatccccatcaaacgctcagacatgctgagggatgtcatccaagaatatgatgaatatttcccagaaatcattgaacgagcaagctacactctggagaagatgtttcgagtcaatctgaaagaaattgataagcaaagtagcttgtatattctcatcagcactcaggaatcctctgcaggcatactgggaacgaccaaggacacacccaagctgggtctcctcatggtgattctgagtgtcatttttatgaatggcaacaaggccagtgaggctgtcatctgggaggtgctgcgcaagttggggctgcgccctgggtatgactgggctctctcagcgcttgctgtccgtgttgtcctttggcaagagaggatggtcctaggattgcatcagtctggtggtctggtggagcgggtggggtgctggactgggtagagggcccagggttctgacctgggtggatgacgggcaaatggtcctgaactctctgctgtctctctccttaatgtcctctgtctgttctaagctgagatgttagatagaccttcagggatccctgacaaagaggcatctggtcttaactgcttgcttctagtggccatgtgctcattactttcttcacttcattgagactgccccatgtgctagagaggtctcttccatgttgggaaatgcctctgccctcatctgggcagttctgatctgtgttcatgggttatttttcccattgtcagggtgaggcattcactctttggggaagtgaggaagctcatcacagacgagtttgtgaagcagaagtacctggagtacaagagggtccctaacagcagaccacctgaatatgagttcttctggggcttgcgctcctaccacgagactagcaagatgaaagtcctcaagtttgcatgcagggtgcagaagaaagaccccaaggactgggctgtgcagtaccgcgaggcagtggagatggaagtccaagctgcagctgtggctgtggctgaggctgaagccagggctgagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6162 - DNA, 1676 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcagccaggctttacctaccactgaggtaaccaatactcaggcttcttcagtcactgctcagcctaagaaagccaacaagatgaagagagttactgccaaggcagcccaaggctcccaatccccaactggccatgagggtggcactatacagctgaagtcacccttgcaggtcctaaagctaccagtcatctcacagaatattcacgctccaattgccaatgagtcagccagttcccaagccttgataacctctatcaagcctaagaaagcttccaaggctaagaaggctgcaaataaggccatagctagtgccaccgaggtctcgctggctgcaactgccacccatacagctaccacccaaggccaaattaccaatgagacagccagtatccacaccacagcagcctccatccgaaccaagaaagcctccaaagccaggaagacaattgctaaggtcataaatactgacactgagcatatagaggctctaaatgtcactgacgcagctaccaggcagattgaggcctcagtagtggctatcaggcccaaaaaatccaagggcaagaaggctgccagcaggggcccaaattctgtctctgagatctctgaggccccacttgccactcagatagtcacaaaccaagccctggcagccaccctgcgggtcaagagagggtctagggctcggaaggctgccactaaggctcgggcaactgaaagccagactccaaatgctgaccaaggggcccaggccaagatagcctctgctcagaccaacgtaagtgcccttgagactcaggttgctgctgctgtccaggccctggcagatgactatctggctcagttgagcctggagcccacaaccaggacccggggcaaaagaaaccgaaagtccaagcatctgaatggggatgagagaagtggcagtaattacaggcggatcccatggggccggaggcctgcaccaccgcgagatgtggcttctcgtatggctagtgaggtttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6163 - DNA, 613 bp, Homo sapiens
gggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaagaccaagaaggcccctataaagactattactaaggctgcacctgctgcccctccagtcccagctgccaatgagattgccaccaacaagcccaaaataacttggcaggctttaaacctgccagtcattacccagatcaccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaa

SEQ ID NO: 6164 - DNA, 270 bp, Homo sapiens
tagaagcatcaactgagcaccaaacaaaaataattctgatagttctctctctagcctcatttaactagggtaggatattggtgtggggatatagggagttgctttagtgttactctagtcagtgttactcaaaatgtagtccacaaacaagctagttcacagacaggtaccagtccacaaactattcattaccagtccacagtgagataagagaccaatgccagaatgtaaatccacacactgcttctttcattgaggaagtcttactta

SEQ ID NO: 6165 - DNA, 421 bp, Homo sapiens
tgtatcaggctgcctaaatgaaccctattgtttccagttcttaaaaatttaagggctatctaagaaaagtttaagcaaaaccctcattccaaacatgcgaccttataataagaacttcctttaaagatgagcagcaaggttgggtatctgatttcactaagtaatattctattgtggtcagaaatgggtaatttgcatcatttggtcactatcaatatttgtgttggagtctgcaagatatttcaacaaagtaagccaaaccactatcttaggggattgttgctggactttggaatataaggctgaacagtgatgtgaagtcatgtttgggggctggaagaagtgataaatgcaaaggttggtgctaaattaggaaccccttgaaggagcaagctgattaaaaaaaaaagctggcagacaa

SEQ ID NO: 6166 - DNA, 447 bp, Homo sapiens
aatgctggcacaataactactacagggaagcagaagagaatgttttctgaatttaggcaaactagatgcagttctgactatgctattacttatctaaataaccagcaaatagcaacttgtctttgcaaagcaaaagattatttttcaaaaactttcatatatatatgattttgattcctcaatcactttttattgaaatgattactatttgccatgtgtgactatttacatgtgtaggttattaagggccaatatatatttttgtttgtgttaaaatgtccaaaagaaatttactcacatagggcatttatagaactgaaggaccatggattatcgaaacgattttggagaatatgagtgatggaccatagccattcatgcaataactatttattgattatgtaatatatgttagtctttgtgctaggctcagacattgtgagacag

SEQ ID NO: 6167 - DNA, 483 bp, Homo sapiens
ctgggcacaggtttgtctgagaaccagctgaggcctgtgttgcgcatgggacctactattattctttataatattaataccaaggacatttaacacctgcaacaacaagaacaagcacagtctcagaaggaaagcccgtcctctaaaagagtgtctgtagagcagagaagcccccagtgccatccttctctttctgccaagctcctgtgccagtgctgtcgtggggggccctgcctgcaggtgtggggatactggttcagggccagtggcccctggcaactggtttgtcttttagagaaggcaggactgaaatgatcagctttccatgtagggccagactctgggcaggtttctttttaaattttttaaatttttttgagacaggagaatcacttgaactcaagaggcggaggttgcagtgagccgagatcgctccactgcactccagcctgcacgacagagcaagactccatctcaaaaaac

SEQ ID NO: 6168 - DNA, 403 bp, Homo sapiens
aaaatcttaaccttcttacaacagatgttgggatattcacggattgtccacaacttccttctcccaacattacttttattcttacatctcaactgccacaaaaacctagaagcatgaaatactacaaattagaaacaaattccctgctatacacaaattgtaaaagtaaaccaagaagaaagagaatatatgcgtacttatacagcaagtaaatagattagactaatgagaactcttcttcagtctagcccaggctcacatagcttcactagtgaattctattaaacacttaatgaataaccaatccttcacaaacacttgcaaaacagagaagcaggaaaacatcaattcatttttgaggccagtattacccagataacaaatcagacaaaagcagcacaag

SEQ ID NO: 6169 - DNA, 573 bp, Homo sapiens
gcagaaacatccagcttgtttgtgcttcttaccttttttcatacacataggctgtagaaaattcatgtagaattttgtataataccatgttgggatgttaaatcatgaaacaagcatttaagtagaggaaagcaaagttttggtatatggatatagatgtcatgaataaagagatatttcccaatgagagataaccatttagaagcaaaaccctctgtacttttttgtcttaagactattgaaagatcttttactgattttgaggttgctgtaaacattatgtcatgttgtatgtttttaaatactaattgtttcagtactattgttttctttttctagcttgtccacgtggtggtattttgtatctattattctttctactcattattacttttcctttcccttagaaataatagcaaaataaaggctataaaatggccacttgtttcatactaaatgccactcagagggtctcaaattactttgagaagacctttttgcctcttcttcctctctaaaaccacccataaacaagagaatgagaaagaaatacaaattctattttgaaattag

SEQ ID NO: 6170 - DNA, 256 bp, Homo sapiens
gcgtcgaccacctattgagctctgcccacatgccaggccccacgtggtgcaccttatgaaaagacacctgtgacactgtgcaatgttactaggtgccctacaagctcactgagggcctgagttcaaatccagcccaaccagaccacacctttttatccttcaggctaagcccttcacagaaccaggagaatcaccaccctatagcaagctccagggtctgcagatggatgggcactttctcgtgcaatgcacacag

SEQ ID NO: 6171 - DNA, 857 bp, Homo sapiens
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggtgttggatgtgccagcgcctctggccgtggcccgctaaccagcctctcccgggcgggctcctgccgcgccccctctcgcttgccccctcctcctcctcctcctgctgctctcccccctgctcccaggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatct

SEQ ID NO: 6172 - DNA, 500 bp, Homo sapiens
gggaagaaacccaagatgcctgactttctgccttggagactgaaagaaacaagggcaactcaccaaacagaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatct

SEQ ID NO: 6173 - DNA, 730 bp, Homo sapiens
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgtaagcaccccttgctccatcctgcgccccaatacctcagctagcccccttccccacttcttacactccaaactcagccgggacagacctctgctgccgccgcccccacgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatct

SEQ ID NO: 6174 - DNA, 621 bp, Homo sapiens
gcggctccggctccggctccggctcccgggcatttaaaggggacgcggcggctgcccgggggggatgaggggcaagtggaggggacggctcagacgcacatcatcctcagtccctcgggactggagggactcgtgagccggagcccagaaatccgggggtggataagacaccgcgtcccctccaattcccgaacgtgtgacgacggctggaggccaacagagtccctacaggtggtgctcacggtaatgcaccgacaatgagtggctgttttccagtttctggcctccgctgcctatctagggacggcaggatggccgcgcagggcgcgccgcgcttcctcctgaccttcgacttcgacgagactatcgtggacgaaaacagcgacgattcgatcgtgcgcgccgcgccgggccagcggctcccggagagcctgcgagccacctaccgcgagggcttctacaacgagtacatgcagcgcgtcttcaagtacctgggcgagcagggcgtgcggccgcgggacctgagcgccatctacgaagccatccctttgtcgccaggcatgagcgacctgctgcagtttgtggcaaaacagggcgcctgcttcgaggtgattctcatct

SEQ ID NO: 6175 - DNA, 439 bp, Homo sapiens
tgacaacttgatgatctttccgcaagctaaaaatatcactctggatcacagcagtagaggactctgtaaatttaatctgtgtgtctcctgtaaataagtgcattagcagtacacaggtggtgtcagagtcagtgatgatggatagaaattctacataaaatccaggctcagtggctcatgcctttaatcccagcactttgggagtctgaggcgggtggatcacctgaggtcaggagttcgagaccagcctggccaacatggcaaaacctcgtctctactaaaaatacaaaaattagctggatgatggcacatgcctgtaatcccagctattcgggaggcggaggcaggagaatctcttgaacctgggaggtagaggttgcagtgagccgagatcacgccattgcactccagcctgggcaaaagagcgacactccatcgc

SEQ ID NO: 6176 - DNA, 1918 bp, Homo sapiens
agcaaaggaaagccacttccaaggtctctttccatgatgtccttttgatgctgtgtttcctgaaagaatgagaaaagtcctccccagtccggggcccatgagcaaccaccattggggaagcggcatccaagccccctgggcacctcgctgagtcacctttcctctcccttctctcctcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaattcttttcccctgtaaaaagttttatttgtttactttaattcttttcccagaaaagagtctttgattcaccaaacatgaatgtacattttctaacaaactcaaaatctgggaccaaaacatcaacttttttctttcttttttctttctttttgttttttctttcctgtaaagaccttgaaaagaccttgaaaagcagtaacttgggtccagtatttacggaggcgttgtgaatgtgtcccatgcataacacactactggatagtgagtcgtgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 6177 - DNA, 4738 bp, Homo sapiens
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaattcttttcccctgtaaaaagttttatttgtttactttaattcttttcccagaaaagagtctttgattcaccaaacatgaatgtacattttctaacaaactcaaaatctgggaccaaaacatcaacttttttctttcttttttctttctttttgttttttctttcctgtaaagaccttgaaaagaccttgaaaagcagtaacttgggtccagtatttacggaggcgttgtgaatgtgtcccatgcataacacactactggatagtgagtcgtgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 6178 - DNA, 4834 bp, Homo sapiens
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaattcttttcccctgtaaaaagttttatttgtttactttaattcttttcccagaaaagagtctttgattcaccaaacatgaatgtacattttctaacaaactcaaaatctgggaccaaaacatcaacttttttctttcttttttctttctttttgttttttctttcctgtaaagaccttgaaaagaccttgaaaagcagtaacttgggtccagtatttacggaggcgttgtgaatgtgtcccatgcataacacactactggatagtgagtcgtgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 6179 - DNA, 1365 bp, Homo sapiens
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcaggaaccagatgccatctttattgagatctcaaagaacagcatcctatgggaagacagaagaaaatgccaaggtcgcttccttcag

SEQ ID NO: 6180 - DNA, 1911 bp, Homo sapiens
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatacgctggaggctggaagccggagatcaggatgtgaacatagttgggttctggtgaaggctcattttccagcctacagacagcctccttcttgctatgtccacacttggcagaaagggagagaaattcagggcatgaatcaaattttttttgtatcttctttatcaagtcactggtatctcttctcttaaggacattaaccctatcatgaacaggctaccctcattagcttatctaaacctaattacttcccaaaacttcatctccaaataccatcacactaggaattagagtttcttcaacatattgagggtatttgaggggacgtaatttagtccataacacacagtctctggcatttaataaaactcaataaattacaacaatattaggaata

SEQ ID NO: 6181 - DNA, 3718 bp, Homo sapiens
atggcaggagtgggcttctagtaaaaaagatgagttcagcccctttcctttctctctcgcacacatatttgctcgcctttttgtctgccaacatgggataaagcagcaagaaagtgcttgccagatatgggtccttgaaccttggactgcccagcctccagaacttgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaattcttttcccctgtaaaaagttttatttgtttactttaattcttttcccagaaaagagtctttgattcaccaaacatgaatgtacattttctaacaaactcaaaatctgggaccaaaacatcaacttttttctttcttttttctttctttttgttttttctttcctgtaaagaccttgaaaagaccttgaaaagcagtaacttgggtccagtatttacggaggcgttgtgaatgtgtcccatgcataacacactactggatagtgagtcgtgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 6182 - DNA, 3933 bp, Homo sapiens
ttcaactcttggcctcaagtgatctgcttgcttcagccttccaaattgctgggattatgggcatgagccaccccagcacccggccagtgccacatcttagaacactcttgaggtgctttttgatttttaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtgatccgaaagggagaagtcagctgttgttggacctgtacaccttgtaaggagaatgagtatgtctttgatgagtacacatgcaaggcatgccaactggggtcttggcccactgatgatctcacaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtacaaagacaggagactggcccagcacaagtcggaaatagagtgtttcacccccaaagggagtatggggaatggtgggagagcaacaatgagcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggcggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaatatgccaagggaccccttaatggaaacacagatcagtagtgctatctcatgacaaccacaagaaaccgacgacaaatcttttgcgagattttcttctagtggcttagaaacatggcttttaagaaacacggtgatatctttgagggtgacaaggcgtctcttcaaacagttccataccaactgctttgctctagggaagcagtgcgtgtgaaacagcgtaacggagggtgaagagcatagttaataagcaactgtaaaaagttttatttgtttactttaattcttttcccctgtaaaaagttttatttgtttactttaattcttttcccagaaaagagtctttgattcaccaaacatgaatgtacattttctaacaaactcaaaatctgggaccaaaacatcaacttttttctttcttttttctttctttttgttttttctttcctgtaaagaccttgaaaagaccttgaaaagcagtaacttgggtccagtatttacggaggcgttgtgaatgtgtcccatgcataacacactactggatagtgagtcgtgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatc

SEQ ID NO: 6183 - DNA, 1314 bp, Homo sapiens
cgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggtagagggacaaagaaggaagagatgcgtaagagggatcagacattgatgttatcttttatgaggttcaagctattctcatgcctcagcctccagaggagctaggattacaggcatgtaccacacccaggaagttatacagatacacgttcctctgaacttcgccaatacttacagtattgtacaatacttatttgtgacttctcatcaacaccccaactggttagatgctgttatttttactggttgtatattaagacaataaaaaatttcgtacttgggta

SEQ ID NO: 6184 - DNA, 1279 bp, Homo sapiens
aattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgtaaaatg

SEQ ID NO: 6185 - DNA, 382 bp, Homo sapiens
acaaccattttcagaggagtctgaaaaatatagaagggcagatggatttgggtggaaagctagcagattccaccataagagcacctggtcatcatgctaaaacgctgaaatgctgtcaggcctatgatgacaaaaggagccatcactgacaccaagcgttactggatcaggtgtgtacaaagaacccaggatccacattttccagagcagagcaaattagaataaggtaatttccagcaggaaggagcaaataaatggtacagcaatatataaaatcttaacacagaaaatgttttaaagatttagactaatgggaaattgaagcagctggacaagcttccttcttggcacacaattactgcagcaatgtcttcttttttaa

SEQ ID NO: 6186 - DNA, 548 bp, Homo sapiens
agacagggtctctgtggctcaggctggagtgcatggctcaatcacggcccactgcaacctccacctcccgggatcaagcgatcctcccacttcagcctcctgagtagctgcaaatacaggcacagactaccacgaccatctagtttttgtattttttgtagagaccaggcttcaccgtgttgttcaggctggtcttgatctcctggattcaagcgatcctcccatcttgacctcccaaagcgctggaattacaggcatgagcactgcgcccagtgagagctggagaaattttatctttcacaaacgcagatgttcatttattgaagaaatttcatgaaatttgtggactgtatgtaagtgcatacagaatgaatttccacatacccaaaacaatgaaaaagcctggcacagaagatgggaaaattgatctgggcaacagtggctcatgcctgtaatcctaaaactttcagaggccaaggcaggtggatcacttgagtccaggagttcgagaccagcctaggcatcacagcaagagaccccatctctac

SEQ ID NO: 6187 - DNA, 163 bp, Homo sapiens
tatataaaaaaataataataataactctatgtactttaggttaagaattgaaattgaacagaactaaatataatcaagagagtaaagataagatagaaatgaaagacactagtgaaagcataccacaagcagaattccttgagtttcctctagaaaaaaaaaa

SEQ ID NO: 6188 - DNA, 228 bp, Homo sapiens
tcactgcttctcccatatgagacaacagcactttcttgactagtaattacaataaataaaatagcaattagtccaaataatacaattattagtggcaggaaattttatcctccatcattactaccaatccaaatattctgcatatccctattaggtctcgaaatggttgtcagggttattcctcgagagaagagaaaatcaagctctcatcaattcttctttctttct

SEQ ID NO: 6189 - DNA, 481 bp, Homo sapiens
aatataaagtggaatcctggatgggatcttagaacagaaaaagggcattatgaaaaactaaggaaatgtgaataacctatggatgactttagtatcaccactcattaattgtaacacatgtaccatactaacattagattttaataatattggaaactagacatggggtacatgggaactctcagtatgatgtttgaaattttgtcaatctaaaaccataggctgggttcacgcctgtaattccagaactttgagagaccaagatgggcagatcttgagctcaggagatcaagactagcctgggcaacctgtcaaaacccagtctccacaaaaaaataattagctgggcatggtggtgcatgcctgtagtcccagctacttgagaggctgaggtaggagaatggcttgagcccaggaggcggaggctgcaataagccaaaatcatgccactgcattccaacccgggtgacagagccagatc

SEQ ID NO: 6190 - DNA, 465 bp, Homo sapiens
gaatttacttttagtgggactgaaccgaactcaagctaaatcctgagactttggacacagacagcaaaaaatatttaccagaatttacagctgtaaataccccggacacaccccatgtctgccaggaatcatctatttgggggattttgcaagcttttcctattctgcagccaatggcaactaactcagtcaacccatttggaaagaaagaagattcactcttgctgccattcatcctagccactcagggacaaagcagacataacttccttctcctggagcatgaatgaccgtagaactggccattccttaatgatatggtttagaaaatggagccctgattagaggggcatttttcatcatgctgttttcactttcctgctctagttggccatgaacaaacatatatcgttagaaagcctaaccaatactttcccggggccaatcttctaataaaatgacagt

SEQ ID NO: 6191 - DNA, 381 bp, Homo sapiens
tattttgaggtctctgtgtggtatagtaattgagaaagaaagttgagaatgtactgtgttttataattggtgatcctgatggggcgggcagtgtggcgctccagagctgctgtgctgtggtgggcggaaggaggtttctcttttaatgatatatgctaaataaagaagcaaaggggaagtgctgtacaaatgctgtgattaaataactattagaatggagccagcccctccaccatgtgctggatttcatcgccacttgcccacgcagaagcttttctcctgaaattatccccttgctctcaggcagcctctgtttttttcctctttactccatcattttcatcagcaagtaatatggccctcccatttttcatttaaaaa

SEQ ID NO: 6192 - DNA, 457 bp, Homo sapiens
cctttttgctttttaaaccataaatacttgttttaaaaatcaatattagccctggttagattagattgagtgtggtaaagcagaaataacaatgaattgggaatcaggacctatgaattctagccccaaatggctgtacacatgaatgtgctggggaggaaaggtttggctgatcacataacttttcctggcctcatgttcttcatgtagaaaatgaaggggttggattagattagtggttctcacagtgtggtccatggacctttttagggtcacaaaacaccttttaggcagtctgtgaaggccttttctttttgtactgtgtcaatatttgcactcatggtacaaaagcaatggtgagtgtacttgctaggttcctaccacatatcaaagccatgtcaccagatgactaacagttattctattcttcagtgttatgtactcatttaaaaaaaaa

SEQ ID NO: 6193 - DNA, 919 bp, Homo sapiens
gcaggcaggaaggtagtataagcagtccattcaataattaataagccacttaggtctgcttcaagtcctttatcttacagataaaggatgtgttcaggaacattaatggttgatgagaaaacattatgccaaataaaatatgttgggtaatcttgaaattgtcatgatttagctgggtgagtacttctttcttatatatctaacttaagtcaattcgagaaaagcctattgagcacatagaatgcctacctcatccccagcaccacggaaacatagaatctcaaggtcagcagggtcctcaatcccaaaattgtataagcagccagccagtcacgattggaatgcttccagggaaagcacttcattgcatccagaggcagtttactccatgtcctgacaatcccactagagttttctttttagagctgattttctttttaatcttcacagcttcttcccttagttctagttatactcctgtattgagcagcttttataggccagatgcagtttcaggtgattttcatgcattcagtcatttaaccccacagtcatcacatgaggtggggtctcccattttacagatcaggcaactggcacaaagaaattaagtgatttgctcaaggtcagtaactactgagtggcaaagcactctgtctccattagtataccttcttcttttcttttcttttttttttttttttttgagattgtgtctcactctgtcgccccggctggagtgcagtggtgtgatctcagctcactgtagcctctgcctcccaggttcaagtgattcttatgcctcagcctcctgagtagctgggattacacatgcatgtcaccacaccttgctaattttttaatttttagtagagatggggtttcaccatattggccaagctggtcttgaacttctggc

SEQ ID NO: 6194 - DNA, 572 bp, Homo sapiens
tatattatttaactcttaaatgttgacttttactgtatattttatatatttttagtatattactcatttctgaaccacatataggaaaagtaattggagaagtggttgtctacaattattttgaagagctcaaatatagaaatggaatgagatttgttcatatcctttagaatcaatggctggaaggttcagggaagcatatttaaaattagtacaaggaagacttattaatggttagcgctgcctaaagatcaggtaggttgcctctagggttatagaggccttcaggtttagactagaaaaaatttctataaaaaattcagttatccagtgagtaaatagataacctttagggttaacctttgccacctatgacaggctgcagatcatgagctggcctacaaattcagctgtaggatggtttattgtagactatgtacataaaatatggttttatattttattacaaaacattgaacatcctgtgctagatatggaaaaagttcaggaaacatcaagagctctccctcttctccagtggaattgaaaaaataaagtaaaaaacaaccaac

SEQ ID NO: 6195 - DNA, 3171 bp, Homo sapiens
  misc_feature (1342)..(1342): n is a, c, g, or t
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcnctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgctttttttttttttgcttttatgccattgcagtcttgtactttttactgtgatgtacagaaatagtcaacagatgtttccaagaacatatgatatgataatcctaccaattttcaagaagtctctagaaagagataacacatggaaagatggtgtggtgcagcccagcccacggtgcctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatt

SEQ ID NO: 6196 - DNA, 2529 bp, Homo sapiens
  misc_feature (700)..(700): n is a, c, g, or t
aagagagtccctggcatacagagactggctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcnctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgctttttttttttttgcttttatgccattgcagtcttgtactttttactgtgatgtacagaaatagtcaacagatgtttccaagaacatatgatatgataatcctaccaattttcaagaagtctctagaaagagataacacatggaaagatggtgtggtgcagcccagcccacggtgcctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatt

SEQ ID NO: 6197 - DNA, 3115 bp, Homo sapiens
  misc_feature (1286)..(1286): n is a, c, g, or t
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcgtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagagtcnctttcaagataaattctgtcattaatcgtttcaacgtggaagaggacatgacggaacagatcaaagcactaaaccctgtccgctggaaagtgttccagtgcctcttaattgagggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaaaatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgctttttttttttttgcttttatgccattgcagtcttgtactttttactgtgatgtacagaaatagtcaacagatgtttccaagaacatatgatatgataatcctaccaattttcaagaagtctctagaaagagataacacatggaaagatggtgtggtgcagcccagcccacggtgcctgttccatgaatgctggctacctatgtgtgtggtacctgttgtgtccctttctcttcaaagatcctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatt

SEQ ID NO: 6198 - DNA, 1659 bp, Homo sapiens
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcgtatggagaagatcaacttttcaggtggagagccatttcttcaagaccggggagaatacctgggcaagttggtgaggttctgcaaagtagagttgcggctgcccagcgtgagcatcgtgacaaaacaaagatacgctttccatttgatgatggagttgacatggaggcagtgcttgcattgctttgttcgcctatcatctggccacatgaggctgtcaagcaaaagaataggagtgtagttgagtagctggttggccctacatctctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttagctgcaatt

SEQ ID NO: 6199 - DNA, 1558 bp, Homo sapiens
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagctcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgtgctccatgggatggcattcttcttattgctattgctatttttattgttggttcttatatttccttccctcctgggccttcagccaggcctgctgaggaactggaagggaggaaaaactaatcttgcttactctaattgcttttcaagctgtgcacggcattatggcagttttagttccttagggctctcagtaaacaagtttggcaagttagataatagaccttttactgagatgactatcttgtacattgcaatttagcaaatacaagatctatggccttagtttagacactaggtaggaaaattaacacatttgacagctttgtaataaaatatctctgttgggactggac

SEQ ID NO: 6200 - DNA, 1011 bp, Homo sapiens
gagttttgctctgttgcccaggctggcgtgcagtggtgtggtctcggctcactgcagcctccgcctcctgggttcacgccagtcttctgcctcagtctctggagtggctgggactgcaggcacgtgccaccatgcccagctaatttttgtatttttggtagagacagggttttgccgtgttggccaggctagtctcgaactcctgacctcaagtgatctgtccgcctcagcctcccgaagtgctggtattataggcgtaagccaccgcatcctgcccagacatacgaaatttgacaggtattgtgtaccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtggcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaaaaaaaaaaa

SEQ ID NO: 6201 - DNA, 763 bp, Homo sapiens
agattcacactgagtccatcccgcctcagcctccaaaatgtgcaggggataacatggcactgagcctctgtaccataggcatgctttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtggcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaaaaaaaaaaa

SEQ ID NO: 6202 - DNA, 760 bp, Homo sapiens
ggagagttgagaccagtctctctctcctaatgcagaatcccatagccatggttgctatacctatcctgatggtccggaataaaatctagtcttactgtgctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtggcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaaaaaaaaaaa

SEQ ID NO: 6203 - DNA, 377 bp, Homo sapiens
ttgagacagagtctcgctctgtcacccaggcttgagtgcagtggcgtgatctcagctcactgcaacctctgcctctggagttcaagcaaatctcatgcttcagcctcctgagcagctgggactacaggcgcacaccaccatgccctgctaatttttgtgtttttagtagagacagggtttcgccatgttggccaggctggtctccaatttctgacctcatgtgatccatctgcctcggcctcccaaagtgctgggattacaggcatgggccaccgcacctggcctactcacctcttgaggtggcctgtggcaaatttcatggctttaggttagcaaatctggaagggaaactaggggcagagagaccctccaattat

SEQ ID NO: 6204 - DNA, 318 bp, Homo sapiens
gcaatatttctttctgtataaaaagaggaagcatgtaggcagattcgaatttagtttttggtctgtttaattgcattaatatgctctttctgccatcttttgggaccttttcagtagctattgttaactcctttaaagggtggaggtgagattcacattatgccattttgcgaagtgttggtagaagggtaggtaattcagtctactgaggtttgagggtggtttatctggttctctctgtgtccactgaaaagatgtaattacgagttgactgtcttttatagagcttagaaaataggtctgctgcaggtggctgta

SEQ ID NO: 6205 - DNA, 388 bp, Homo sapiens
tgtcgggcccatctgccaaggcaagcacccacattaaagcagagtgaagagcagggcgagctgtgtagctcacctgcctttgaccctgcacgtgacgggcgagggaagaggaccatggtaacttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaag

SEQ ID NO: 6206 - DNA, 495 bp, Homo sapiens
gttgaggcaggtgaatcacttgaacccgagaggcagaggttgcggtgagcctagatcacgccactgcactccactggtcttacgctgcaccaagctggagtgcaatggtgcagtcttggcttactgcaacccttgcctccttggttcaagcgattttcttgcctcagcttctcgtgaagccatgtagctgggattacaggtgcctgctaccacgcttggctaatttttgtgtttttaatagagaaggggtttggtttcaccatgttgcccaggctggtctggatcacgaagtcaggagttggagaccagcctggccaatatggctgtctctactaaaaatacaaaatttagctgggtgtggtggcgcgtgcctgtaaccccagctactcatgagactgagccagaagaatcgcttgaacccaggaggtggaggttgcagtgagttgagatcgcactactgcactcacagctggcgacagagcaagattccatctc

SEQ ID NO: 6207 - DNA, 414 bp, Homo sapiens
tgtgtttaaacaagaatatgtgagtcggacagtgtgctctttgactgaaaacctgattcagagaagttggcttattcctttgcctttgaccacagctttgttggaggtcagcagcatcctaagagccagggagcaggccaggcacagtggctcacgcctgtaattccagcactttgggaagccagggcaggtggatcacttgacgtcaggagttcaagaccagcctggccaacatggcgaaacctcatctctactaaaaatacaaagcaattagccaggcatggtggcaaatgcccataatcccagctactcaggaagctgaggcatgagaatcgcttgaacctgggaggtggaggttgcagtgagccaagatcatgccactgcactccagcctgggtgaagtgagactctgtc

SEQ ID NO: 6208 - DNA, 683 bp, Homo sapiens
ggcgcacgccatcatgcctggctaatattttgtatttgttgtagagactgggttttgctacgttgcccaggctggtcttgaactcctgggttcaagtgatcctcctgctttagcctctcaaagtgcagggattacaggcatgaactactttgcctggcctggttatgtctcaattgaagtacagaacaattttttactgcataatagtgagaatagatataaaatagttaaccatcaaagacatttgaaattgttaccacacctatttttaaaaattgtcattaaaaataagtatcaagtttatcttaatttttaactgtacaatacagtattgttaaccatatatacattgttgtacaacttcttttattttacttgactgaaactatacccattgaataacagctctccatttcctggtccttgcaacccctggcagcaagtattctactttctgtttctatgagtttgattactttggatacctacacagtatttgtcttttgtgactggcgtatttcacttaacattcatacatgctgtagcttatgactggatttccttcttttttaagactgaatcatcctcatcactggttctagctgaagtatgatgggatcattcttcctggcaaataaattcctgtttctatccagaaaaccaataaaaagttttccatgaaa

SEQ ID NO: 6209 - DNA, 462 bp, Homo sapiens
ttgcagtgagccaagatcgcgccactgcactccagcctgggcaacagagcaaaactccatctcaaaaaaataaaaaataaaaacctgtccaggttttttgtttgataaattttgtttttgaaatgattttcaaacctaactttacccatgtagccatgaagttaaaacaaaatcctagagtttatgctgtcattgtaagcaattacagatgatggccattacaaaacttcattttactctttgtggaagactagtctccatttcatatgcaatagaagattcaactctcttttgcacttgagaatactaaaagtaaatgtattttagtaaagaaaaaaaacccacatgtaaatgaatgtgtgtcttggagcaactgaattctattcaaaactttggaaggaaacagcaaagtgttagaatacgtgatttttaaagtgtatgtataaataaataccgtgagta

SEQ ID NO: 6210 - DNA, 257 bp, Homo sapiens
aaaccttcatatccagccgtctactcaacagtctcctggattgctcagaggcacctcttaacatatgtaaaccagagggcaacactgacctccccaaacctgcctctcctcctttatgctgccctatcctatgaagattttttttaaaatcagggccgggcacggtagctcacgcctgtaatcccagcactttgggaggcctagacaggaggatcacttgagctcaggagttcgagaccagcctgggcaatgcggcg

SEQ ID NO: 6211 - DNA, 390 bp, Homo sapiens
attcttaccaaatagggttgtaaagaactaagcatgaaaagtagcaaaatgtcagattaattttctctccctgcatttagggattcaaaagccatagagaataataatcgataaattatagttaaggatagactgttcacctagtgactgaataatacacaaagctcttcagaaattttcatgataagtttacttgcctaagagaccataaagaggaaaaatctgggagaagaaagagtcaatataatcagcaatgagaagtctccctttaatgacagctatggggaacctgaatgaagtagtatatacgtacaagtgattggctaggaccataccatagactgctcccataagtatttcctaccacaattgaccttctccagattcagc

SEQ ID NO: 6212 - DNA, 260 bp, Homo sapiens
gaagttgtaggctgtggtgaagtttgtgaatttgggagtcctcaggctcgtctggattccccttttatgccccaagcactggtgcacgcacaccctatggatcaggagtgcagaccgtgtgccccaatgttcaggaccctaggtgtgccaccactctgggagttattgaacgctggccatcagccgaccttgagccttcactggggcagagcagagaaatcacaggttatgcgataattttgtgagatctacctttttgg

SEQ ID NO: 6213 - DNA, 1732 bp, Homo sapiens
tatctgcttgggggttgctgattcctattggggttccgtggaagacccacgcctgatgccctccctcagtaaggaatgcacttccctcctggcatcgagcctggggctagcatgggcattactgggagaactgagacgattgtcacgcaccatcccctgtgatctgtggttctgatgtgcagcctcagctgaaaacggtcttcacctgtggctgtgcttacctgcgccactacttacagtgttttgaagagcaggatgaaaacggcaaaaaccttgactgtttctgctcaagtgtcctgaagtagaggatggtggggatgataaatgcttgctaggaaataagtccaagggctctataggacttcacagggttttagtttatgtctctaactttagcaaagctgcattcctattggaatgcatactggaaacagctctcattcctacctttaaagggctcttggaaagcagtgtgacaaccaaggtcactaaatggtgagatcatcaagccattttaagttctttctcatgttattcaccagcaccctgcaggacgttgggcacacatcacatccctcagctcagccatccagccgtctcagtgattcaccactcatttgcttaattaatagacaggtttgatcactttgtacatggaaggcactgtgccagtgaacaagcagttggacccagccctccagtagggaatggacagctgaaaatccatgagcaagaaagaaggaaaaagaaagagttctgagcagccaaaccatttctcgatgatttcagagccttcattctgagcatcagttatatgctctccagtgtaatgactttatagccaagcacagtaattgatattactgtgaaggcccttaacttatcaagaaatggttgaggccgggcacattggctcatgcctataatcccagcacgtgggaggccgaggcaggcagatcacttaagcccaggagttcaagcccagcctgggcaacatgatgaaagcccatctctacaaaaaaaatatacaaacaattagccaggcatggtggcatgtgcatgtagtcccatgtagtcccagctacttaggaggcagaaacacctgagcctgggaggtcgaggctgcagtgaattgtgctcacaccactgcattccagcctgggtgatggagtgaaaccctgtctcaaaaaaaaagaaagaaaagaaaaagaaagttgacttagctatactccatataagaaggtatagaaatatatagagcaatttagaaagattatagtgtccaaagattcaaactcagaaaagaattgaaaggttgcctgccagccatatccccagacgaacctagaccactggggtttcactatcatacagaatagagaaaaacattggttactgacacctgaaatcaaaaagcttggatatttttcagtcccaaaccagaacatagctcccgtatataaatgtaaatcttccttcaaaagtataattaagtataattatgggtgtatgtcaaaaatatagaggaagatggatttttacttataggttgttatacaaagttgggacagcaatcaaatttttaaacagttttcaagaatgtatgaccttaaaagaaatgtgtgaccctgatcactttccatatttgtaattaaccggagacctaatggtctgacacttaagtttccactatcactaggaccctgaatgctaattctggggagtttagatg

SEQ ID NO: 6214 - DNA, 488 bp, Homo sapiens
gctttgactttcataaataatgcttctggaaatctagtaaaacctttaaattttggccaggcatggtggctcacgcctcagcttcccagagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggaataactttattctaggaataaagttgtgtcatctgcaaacatgaatcatgtacacatctgattttcttatatttatgtctcctttttctcttcaaattacattgcctttaccattgatgggaacctgggtaataaa

SEQ ID NO: 6215 - DNA, 470 bp, Homo sapiens
atggttactacaaactatatttgtaatttttttttcttgagatggagtcttgctctgttgcccaggctggagtgcagtggcgcgatctcggctcactgcaacctccacctcccgggttcaagcgattctcctgcctcagcctcctgatataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggaataactttattctaggaataaagttgtgtcatctgcaaacatgaatcatgtacacatctgattttcttatatttatgtctcctttttctcttcaaattacattgcctttaccattgatgggaacctgggtaataaa

SEQ ID NO: 6216 - DNA, 979 bp, Homo sapiens
ggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacatgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctcaaaaaattca

SEQ ID NO: 6217 - DNA, 374 bp, Homo sapiens
ctctgttccctgctttggccagtggctatcctcaatgtgacccacactacacctctgcccacactgcagctctttacccagttaccctccagttcctcacaacgtatgcctatctcagtcatgccccggactgcattgaagccagactgcccttttccccaaggcagggtcatgatttgccaaaggtttcgtgtgtgtgttagcaagactggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctcaaaaaattca

SEQ ID NO: 6218 - DNA, 912 bp, Homo sapiens
gacaagagtttcacttttgtcacccaggctggagtgcagtggcacgaatctgactcactgcaacctccgcctcccacattcaagcaagtctcctgtctcagcctcccaggtagctgggactacaggcgcacgctaccacgccgggctaatgtttgtatttttagtagagacagggtgtcgccatgtttgccgggctgatctcaaactcctgacctcgtgatccgcccgccttggcctcccaaagtgctgggattacaggcctgagccaccgcacgcggcccccttcgtgccttttgaggaagcagcagccttggtcatggcccataagaactcagacttcaactgaaaaaagtggctcttccctacacaacagtccaggaagctggatattgggagtgtggtgagacgagaactgacccatccataagctattctggattctctgtcactctcagccgtggagcatcaagcaggcttcctgaagcttcgggaggacctggcttcagctgctgtctcagctgctcgaatgtaacatggttccgtagttgagacttcagtcatcctgagcaataaaccagctcatccactgaaaaaaaaaaaaaaaaaaaaaaaaacaaaagtgttgggcgcgactacgccccctcgaaaaactcctcaacagcccttccctgggccgccccgcccccactatgctcacgcgacccccgtgcgacacacgccgctcccccacgcacacccgcgcgcgccacaacccaccgcccccgcgcctcccgcccacacacaacagccccccgccggacacccacgcccttccgtcacaccacccccgcaggcgccccccaagccccaccacacggccaccaacaccccagcgcctcccccaccgcacccgacactacaatagcccgccgc

SEQ ID NO: 6219 - DNA, 350 bp, Homo sapiens
ctgacccatccataagctattctggattctctgtcactctcagccgtggagcatcaagcaggcttcctgaagcttcgggaggacctggcttcagctgctgtctcagctgctcgaatgtaacatggttccgtagttgagacttcagtcatcctgagcaataaaccagctcatccactaacttggctcctagcttattacatgtgtgcactccctgcactgatgaaaacaggaaacatggcgggcgcaggggctcacgcctggcatcccagcactttcgaggctgaagcaggaggatagcttgaggccgggagttcaagactagcctaggcaacgtggcaaaaccccatcta

SEQ ID NO: 6220 - DNA, 168 bp, Homo sapiens
cagtctgtatgtggaggcgcacacctatggtcccagccacttgggaggctgaggccagagaattgtgtgagcccaggaggagttccataccagcctgggcaacatagcaagacctcctctcaaaaacagacaaaaaaagtggtgttccagagtgattagtttgcttta

SEQ ID NO: 6221 - DNA, 232 bp, Homo sapiens
aagttgcctagttgtttcatttactgaaaagttcatctttcactaccttgagatatttccttcattgcctgttgccatatgtatttgggtttctcaacattgtgttcctttagtctattcatgaggcggtattcagagatctcctggcaattcttgtttttctatataaatttatttatttagagagagagatatatatacatacacacatacatacatacacagggtcttg

SEQ ID NO: 6222 - DNA, 460 bp, Homo sapiens
ttttttttttaagtgacagggtctcactctgttgtgcagagtgagtgcactggctggagagcagtagtgccatcatagctcactgtaaccttgaactcctgggcccaagcaattttcccactggctcccaaagggctgagattacaggcataagccactgtgctcagctggaaagactcttcctaacagtagaatgccaacaaacaaatgcagaaggaataatggaattagaaaattatcatttggcaactatcataacaataattgattcaggcaattatcccaagacattcattaattgtgaatggaaaaatagtaactttacagtagaaaaacctgacagatatcaccttaactaagtgaccagagacatcattgtgagtgctgggacaaatcaacatcacgtacatcctcaataggatgccctgagctcacagcctctgtggtgttcttatcaaac

SEQ ID NO: 6223 - DNA, 362 bp, Homo sapiens
accttaaatggcacacaaacggtataaattcaagttgatgaacattgagttcaatgtgagttaactgaagagaatagccattggattcttatgtcacccctatttatctctctagagatatatggaggataacttggtggacaaaatacagttagaagctgagaatattggtctcaatttcagctgagaatttgagatgaaacatgtatgcttggaagtcatttatacacagctgttagttgaagctattgtaatgtataagtcttctcatttgtaaagcacaagagagcagggccaaggacagaactcttaagggcaggggaaggagggaagaccattggtgtttaaggactccattcctc

SEQ ID NO: 6224 - DNA, 253 bp, Homo sapiens
tgtttctatatttccttagtaatcatcgtccctcatatggaaatacattggcagtgactaagccactttgagtatagagcagaagtccccagatgagtcatacaggccgttggtggaaggcttcatatttgaaagaaacaaattttatatggagatagtattatttatactcaaaatggctcctctatttaatctacaccttttataagtcagaggaattttttgacctggaggagaaaatcattaattccag

SEQ ID NO: 6225 - DNA, 440 bp, Homo sapiens
ttgagttcactcatttctccttcctttccttattgatcatgggattctgttgtagcagaaagatctgtttgtgttttcgtttatggatattgttttcagtgacagatcataaaatgcaactggaaaaacagtgtagacccaggtcacacagagcacaaggaagttcagaggaattcagtttccaattaaggaataaactctaaaggcccttttgaaggagtgtgatgggaatttgcattctgtaatgttaaatctcttgcttgcagcacttttttttttaagctacaatcctgtttcatagagtaagcaaaatttttaaatattgaaaacctaggaagtaatttagttatctgacattaggttttgagtaactatttagtatatctgcataaccagctgcctcatgcctgtttccccatgctacccttttccttcccagc

SEQ ID NO: 6226 - DNA, 519 bp, Homo sapiens
aatctggggcagcaatgtgctcagggagcgttccccaggagaagagcaaagactgatcgaaagcaacctgagccgccctgctcaccttgtctacgattacctggcagcagagggtgggcctgtgacccagatctggtaggtggggcctgagaggaagtggactggagggttaggtgcttcctccccagggagatgaagacattcaagagatggaaagtcgctcctgcgcttcttccctggaggctgtcttgagaggatatgatcctcccatctgtggcagtcatataagaataggagaaaggcaggtaaagtatagaaaagctaccttgagtcccagcatcactgagctgctgaattaacaaccctgggtccactaataccagtttcttgtttgcaaaataatgaattgtccttattgtctgcactcatttcagttgggcactctcatattttgtaaccaaaggcatcttacctattgcaacaaagaagaaataaagaactacaatttttctatcacat

SEQ ID NO: 6227 - DNA, 256 bp, Homo sapiens
aaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatattaaaattattcatcct

SEQ ID NO: 6228 - DNA, 470 bp, Homo sapiens
ccttgaagtttgacttgtctgttccctcaaatgtgtcgacacttctgaaatgttttctcctttggcacatcggtttgaacatccccagatgtctatggtgtacctcaaaatctggtccttgcagtcggggtgatatgacacatctgttgtctaatgtacctactgtgtgctcacggacaaagccaaataattaatctgggccgggattgttcatgctttcacagttcggttcggcattgatctcttcttgcagaaggcctatattgggaccaaactgggaatgcaacagggcaaagttggtctaaaaatcctctgggaattttccatttggcaattaaattttctgtagattacatctctctatcaattaccagtgtggcttttataatgttataaaatctgagcatagccagttacatttcttttaccctgagtctctgggtctttatctgaaaaattaaaggactaga

SEQ ID NO: 6229 - DNA, 467 bp, Homo sapiens
acaatttattagcattaggtacatttatattactgagcaactgtcaccactatccatcttgaaacatttttcatcttgcaaaactaaaactctgtattcattaaacagtaactccccactacggagctaggaaaaaggtcagaaaccaaagaaaacaagaaatacagccaaggtcaaacctagttagggcaacactatcactatagtcactactgaatactggatttcactgatagcataaaagttaccactgacatatgccaaattaactctaaagcatttctacttctttatttcacctgatttatattcatagtctcaagttggagaatcaaattagttgatcttaagctacttgttcatgtaccacctgccaaaaatcagaaaagttaagtcacctagacccaacaacttcattagtagtaggtaggattgctccaaaagaaaaaagagtttgatgagtagca

SEQ ID NO: 6230 - DNA, 208 bp, Homo sapiens
acttctggttgctttaaactaacttggttcaactcagggtctcttatattttctttaggggaatgaagtcagtttttcagtgttttgtgtgtttgacaacacagtgtcacaaagaaagtaattgatgctttattactttgcaaactcttcatatagtggagtcaaagcctcatgcagaaaacaataaatatacatatgtatgtgtgta

SEQ ID NO: 6231 - DNA, 437 bp, Homo sapiens
gcctaaaaaaaaaaaaaagaaagaaaaaagaaaatattcattccttttcttaaatgcataaaccacccagaaaatatataccttaaaaataaaaaaggggcttagtaaatattttatatttcactcaactggaattataatagaaagggaaactgttttattagaaaatttaccatttgcaggaaggtgtatgtgcctatgcacctcagtctttattaaggcaatggaggaaaaacagccaggaacaaggtgaaaagaagttcattcactgtctcagaaaataaagacctcagactttctaaatgaaaatataccattagcatcagatactaatcacaaggtagttatttttaaagaggttcctaagtaagacacacacacccatgacaccctgaggctaatctatgcacctagagacttattctgccctttgttgt

SEQ ID NO: 6232 - DNA, 393 bp, Homo sapiens
ttttcctagtcctccacagctttcctctgcaaaccttgcaccctaatctagctgtcatcattcatatctataaacttatagttctctttgttttagaagtttttaggtacgttagaaatgtcatcgctggcttttaattaatgttactaccttgacccacaagctatggttaacatgacaagttatggaaatcagaatgttatttagattcaatctctaggtatggagataagctcattttaacaatctttctttaataaactggatatgtgttgagaaaatgcaaactctaatagaaaagataaaaatattcattcatcctcaagaaatatttacctaggacctaaagagtattagtcatctctaccctattaagcagtgtagacaaaaaaa

SEQ ID NO: 6233 - DNA, 415 bp, Homo sapiens
ttttttttgagacagggtcttgctctgtcacccaggctggagtgcagtggtgcaatctcagctcactgcagccttgacttcccaggctcaagcgatcctccttcctcagctcccaccccccacctccacctccacctcagtcccactgcagctgggactacaggtgcgcaccaccatgcccggctaacttggatttttttgtagagacggggctttaccatgttacccaggctgggacgtgggtttgtttaaaaagccattcatagctgacggatggccaaggtggaggctcccggttggtggacgaggagggaccctggaagactgtggtccattcctctgtagttctggaaaaccagccaggaaggaagtttccacactggagcttggggtcaagtagcagcatcgcccaacc

SEQ ID NO: 6234 - DNA, 392 bp, Homo sapiens
accaaaagtcatagtgtccccagtaaacaaataatgctagagctaaagagaaaccataaggtaagcatctaagatcctttcattttcagatatacatgctttagaaaaattgtcttggcatggagactagcctttgggatctagtgccttgaaaaaaaatctgatggtaacatctctattttggtaaattgattcaagaaaaaggcaaagagacaaaaagcaattcaaactgctcatactctttagccctgggaagcctgcaccggcaggtttctggatatggtctattttagttcaaagtgcaatcacactgtataaaatataaagtcactaagaatgaggcatagcacaaataccctagggacctgacatcaggaattagggcaggtcac

SEQ ID NO: 6235 - DNA, 441 bp, Homo sapiens
  misc_feature (24)..(24): n is a, c, g, or t
ccacttcaccaccactccaattangataaagaagaaaacacttccatcaccctgttttcctcatcaaatttgattttagcacttttatttaattgtgctcttaaatttggcaatgagcagtaatttagcccatatgttggccgcctaaaccaatttaatgctaatattgattaactagtgtattcttatcaatctcaccctcatgcctgtaattctagtactttgggaggccaaggcaggaggattgcttgagcccaggagaccagactgggcaacatagcgagaccatttctacaaaaaaatcatttaaaaaaattagccagtcatagtggcacgcactcgtagtcccaattacccaggaggctgaggtgggaggatcgcttcagctcaggagatcaaggctgttacattctagcctgagcaacagagtgaaactgtctc

SEQ ID NO: 6236 - DNA, 176 bp, Homo sapiens
gaaggaaggaaggaaggaatcagagtatctaccacgttgtaagacaagtaagtattggccgggcttactggcacacacctgtaatctcagcactttgggaggccaaggcgggcagattgcttgagctcaggagtttgagaccagcctgggcaacatggtgaaaccccatctctaca

SEQ ID NO: 6237 - DNA, 765 bp, Homo sapiens
tgctggtttgtgtgtgaaaaacattttccccctcttctttccttaacctccttgttgcttaggatgaggagactctgtaatttaaagcagaggacgagaggaggaagaaacttccatgttaacatggcctactctcactcctttctaaacgagccacttttggcgtcagaagttgactggagagagataaacaaactcccagtcaaagcccctaaagcgacagtgcccagagttcttttattttttgctgcaaccaacgtaaacctgtaaaagaccaacagtgaagattagtgtattagtgaatgcatggaggccaatgctgccctaatgagacgtgataaaaagtccatcactcctctaagccaaaaggaaacaaaataaaaatgaccctttttactgtacaagggaagcctgtcttggtgtgtttgttgcttgactatcccaattcttgagtcctgggaggggtctgggaattgggaccttagcacatttggggaaaggaggggaatagagggaagagaaatcaaaggggctctcgcaaagttctggctaagaaggagagattggaagaaaagcaaggtcctgaccccccccagatccccactcacccattgcatgtggcattccccactactggccggtgcttagaggcccataaaacctctcttcacctaatccacctggcagagccctcagagatgacgtcagccaacccagctggactggccttacttctgcctttttcacctgtatgttaaaaaacaa

SEQ ID NO: 6238 - DNA, 223 bp, Homo sapiens
cagagagcctagaaaatatcaccttgtgaatatctacttccatgaagtcagtgacacatttttaggtcttaaacctcaatatttaaaatatttgtctctggaatttgaaaataagatgtatgctttgtttactggataaaaaggttaatcacttgttcatctgattagtaatcaaagtttctaaaatttatttaatacttgatgttactttatgttttatata

SEQ ID NO: 6239 - DNA, 197 bp, Homo sapiens
aatattatgatcagagaacagacttctttcatacaacttacccactaatctgttttgaaatgtctgttatcttttaacattatatgttttgtggccttcttctctttctttatgtattttcagtctggggtagtggtggtatagtacttcattcataatttgaaaatgcttattaaatcattctatatttcgaaaac

SEQ ID NO: 6240 - DNA, 1077 bp, Homo sapiens
cagtgcctgtgaagtggcctttggtgtggtctcagtggagacaggcagaggtgaaaatggcacgagagggaagccaggtgttctatcatcttcggatgcttttgcatgcaaagttaccaagggccacagagttattaggaaattaaaatttaaaacagggtatgaacattgggttgaataactaaactgcttccaagagtggaaatgctgagctgggcgtgctggctcacgcctgtaattccagcactttgggaggctgaggcgggtggatcacgaggtcgggagatcgagaccatcctggctaacacggtgaaaccccatatctactaaaaatataaaaaattagccagacgtggtggcgggcgcctgtagtcccagctacttggaaggctgaggcaggagaatggcgtgaacccaggaggcggagctttcggtgagctgagattgcaccactgcactccagcctgggtgacagtgtaagagtccatctcaaaaaaaaaaaaaaaaagagtgcaaatgcttagggcagtagaggcaggattgccgaaggagcagaggtagcccggtgaggagcttggtggttccttgggagaaaagcatagcgccgtcttcccagcgtgcatgaagggtgaggtggagcagacgtaatcatctttccatccatcagaagagtctgtgccagaaaacagtgacttcctgtggcaagacatcaagtgacttaagcaaacaaggaactgaggattgaaggaaaaaggctatctcgattttctggtattaatgataaaaggggattgtagcttattaatcagttgagtctggttccttaccttctgcccctgtgactgttatcttgtttctgaagtgtcagttggagatagcatttggtataatacttttaggattcctctgtttccatccacgggttgtgctgtcctaattgtagacaactagtaggaaaatgggagctctgatccctcctgttctgatgggctaaaatagacacataaactcattataccatctggactaatttcattgaccaaatcccattagaagaaaagcaaactatttggaaac

SEQ ID NO: 6241 - DNA, 771 bp, Homo sapiens
ggctccctcatccggcagctcgccgggtcctgccttcctggcctagaggagtcgggcaggacgggtccgttcaccctttctgctggttccggcacccccagcactggtcatcaatctgacccctttccacggacccgtcgcctgctggagcggcccctctgaatgcttgggactcccttccctgttacatggaagttacatgcctgggcttaaatcccgacgctgccatttactagccaagtaactttgggcacctctggtctccgtttcctctttttaaaaatcgggatcataatataagttagggtcacagtagaaacccctatattgtgttttggttaccccctcccacacacacacacatcctgggtgtattttttaaaacctatattgttaacttttgaatgaaaataagggcataggagcattgtctatccttgacacccagctattaatctctaaataccaccccccactaaaaggtaccaagtgatccttcgagaaatgactgatgccaggtcaggagctaggagtgaatgaggacaacttggaacatcttgtgtcagaagctcaggacgcctctcaagacgaacgaggtccttctaaaaggacatgggaaccagcctgaagttgcccactggccaaaattagaacaatttgagaatcaaaaataacaatgactgcaaactgaaaaatgattggaaactttaaacataaaaaagccattccccccaaagagtaatccaaattaaaaaaaaaactataacttca

SEQ ID NO: 6242 - DNA, 503 bp, Homo sapiens
actaatacagcagccagaatgatcatttaaaaacctagttataattctgctctaaccacttcgatggtttctgtcttagaatgaaatacaaaagatttatcttgttttgcacagcccttagtaatctagctcctggcttcctagcacctcttctttacctccccctcactcttatctctccttcaccatatttgtagtgatttaaaataccacttgcagcatgcactatgcatactgtacacatagggatgaaatgtatcttggaacacacttatttcaaatgatgctgttggtagactactttatacatctgataaagtagatgtaactcaccttaaacccccaacccctgtgttcataagccctcttactttattttctgctctatgcaagtatcaccttctcagagacggctttcctaaactaaccaccttacattaagaaaactacctttccctggccgggtgcgatggctcatgcctgtaatcctagcactttgggag

SEQ ID NO: 6243 - DNA, 467 bp, Homo sapiens
gctaggaaatgttcgaccttgtctccagggagaggaagtgggtttgctgtgcatctagccagcctctgccacactgcagttgagtgaaatctagttgtcactgaagacagctgacaaaatggataaaggtatttttttacaaatgtaaaaaatggctttcataagaagttataaatggacttataattttttgatatttcttaaagatatttcacctacttttcctctttatcaacggttaaaatatgaggcagcctcaagcacgttatttccaaaacaccttccttgacctctccagacaataagcagctcactgcatttacttctgtgctgggctaccccttagctgtaataactggttggcatacatctcacttggctcaaaactcagagggtgaagactatgtacagttcatcttttaatcaccagggcctaatgccaagaagataataaaaaaagatgtaat

SEQ ID NO: 6244 - DNA, 210 bp, Homo sapiens
ttatttaattagtatttttgaagtattttcactttaagctgaaattcattttaaatggaacttgacatcaataatgaaaatgaaaaaccagtatcacttgccacagatggtcattgtaaaggtaaatttgttgtaaaaacatattgtaatgaattgaatctaatttatttgtactatattattgagtactttgttatctcatgatttatt

SEQ ID NO: 6245 - DNA, 631 bp, Homo sapiens
agatgtgcacactcgcgagcagggatttttctggttcaggaaagtcctgcgtccttgggcgcactttcacaagtgtgagaaagccagttcaaatgtgacttcccgtgagaaaccctgcctggcctcccgccctccccggcactctcagcatgaatcatgctgcgttgtcactattgtcttgctcatctgtgcctgtcgcattccctgagttcctcctggcggggtctcggccttgttcatctttggacctggtggccagcacagagaatgtgctcaatgaatgtttgctggattgaatgacacaccctcaggtccaagtgggccatgcccctctgcctgcagcctggtggccgtcagggtcagggctcccatgctttctgatacccgggaggatgggtctctgaccatgggattttgaaatagcaatgagcctgaataacattttgagatactggcaacaacgaaagtgtggaatgaaacttcccgttatttctgctggctaacactaagtggttgccacctatgttcataatacaaggaactgctcagtttcaaccagaggtgagtgaaaacagatgtcattgttttcccatgtcagttcatgagccctctgggttgtattctcaggtcg

SEQ ID NO: 6246 - DNA, 411 bp, Homo sapiens
gagcagcagctccaccaaccccagttctgtgaccaacagcggcctcttaagtaaccgtttgtttcctcaaaataacactccacctttcacctagcaagaaggatggttatctgcatgggtgccatctttctgggccctccaaatgcggacagctcacctttgctgctaaaaacacctgcttcacctcccagctccaggtcattcctctgagatcttatggaaaagctctcagctaaattggacattaaatactagaggaatggattggttcacatactgggaaagtccagaggtcactggtgaatgcagggctccagttgtatcatcaggtcttagtttctctcctcctgactctgcctgctgctgtatcggcttcgttctcagtttgcacatgatgatcttctaggattg

SEQ ID NO: 6247 - DNA, 663 bp, Homo sapiens
  misc_feature (5)..(5): n is a, c, g, or t
  misc_feature (37)..(37): n is a, c, g, or t
cctgnttgtaaaatatgaggtgagtggagtgagacgntgacaaaacctactcctcccggctgctgtgaaatctacctactgttctgtgaacagataatttttttaagtaggaagcagtttagtctttgcagccccctacttctctttaattgctatgtagcaggcatgaggttaaagcataagctagcccagcgaggatgatgtgctacagtatttatttattttggaaggaagggtgtaattaaccctaaataacagcccttgtggcttgcagaggggagcctcctggccctatcaaaggcgggcagaacagggagggactgaggctgacatgaagtcacagataccgaaactatgtgcctgataatgatataattaggggatcagagatttctgacggctgcggacttcaaaagctttaaaagaagccagcagtctctcctgtagccatcttgactaaagcagacatttttgtttaatcactacatacagtaacgagaagggggcagaaacagaagggcattgttccacagtttcaaaataccagtcccctttctggccttttgcatgccacaggaagaaactttatgaacgacagaaatatagttttaatacagtggtacaaaagtccattctccttgcttaaaatgtggctccaattaa

SEQ ID NO: 6248 - DNA, 297 bp, Homo sapiens
ctgactctaactaaataaatcagaagaagaagaaaaaaagaaagactgaaggggaaacatgcagagttaattcacagaggagcctgccaagtggtctgggtggcagggagatgcacattaaaagaaaagtagatgtcctgccctagccaagtgtggtggggcacgcctgtaatcccagctactggggaggctgaggcaggagaattgctgaacccagaagccggagtttgcagtgagtctagatcgtgccactgcacttccagcctgggcgaccagagcaagggtctttgaaaaaaa

SEQ ID NO: 6249 - DNA, 514 bp, Homo sapiens
gccactgctttgtttggtatttcttgggttatttagttttttagtatatgaatcactgtcttataagtttgttgatggaaacagcatatgctatactttttccgctgtcttagattggaatacttaatgtattcctatttgtagaatgacttggctgtgcactaattttcacagagtagcaaaatttaaccctaccttattgttaagaaagggaaatggaggctgggcttggtggctcatgcctgtaatcccagcacttttgggaggccaagggggcagatacctaggacaggagttggagaccagcctggccaacatggtgaaaccctgtctctactaaaaatacaaaaaaaattagctgggcgttgtggcaggcccctgtaatcccagctgcttgggaggctgaggtaggagaatcacttgaacccaggaggcggaggttacagtgagccgagattgcgccattgcactccggcctggtcaccaagaaggaaactctgatgtaccccaacaa

SEQ ID NO: 6250 - DNA, 617 bp, Homo sapiens
aaaatagcatgttgtagtactattgcaggggatagggagctagtatgcattttagatatctaattggctcttattaatttgtgagacttagtaattattggaatatgaaatattctggcttcagaatttaatgagatgttagagaggcttgattttattgaacattttatatttttgccacctttgtgactgggaatactgagcatataatttatgtgataaaaatgagcatccgtgttcataaggtatcttgatatcattatcacctattttttgtttgctaaatgggcaagtaaaacctactcttcaaaccagaagatatataaccttgaagagataggaacaaagaggaatgatttcatactgatgaatattacgtgagcataagtaggttttattctaattattttgctagagttttgcattagggatgtttgtcatttttgaaatgacattttacttgagaaactgcttatacttttaaaaaaaactagttatacagtatgtgttgtggctcacgcctgtgatcccagcactttgagaggccaaggcaagagaataacttgagactaggagtttgagaccagcctgggtaacatagtgagacactgtctcta

SEQ ID NO: 6251 - DNA, 935 bp, Homo sapiens
caaaatagtaacagatagtaatacataacagtattgaactgtatactcaaagatgaataaaatggaaaattttttgggttttgaaaccacaaaagtagttttggttgacacagtggcttacacctctaatcccagcactttggaagactaaggtggaaggatcacttgattccaggagttccagacaagcttgggcaatgcagggagaccccatttctactaaaaattttaaaaattagctgactgtggtggtgtgcacttgtaatgccagctacttgggaggctgaggcgggaagattgcttgggcccaggagtttaacgcttcagtaaactatgatcacgtcactgcactccagcctgggtgacagagtgagactgtcatttaaaaaaagacaaaataataataactttaaaaaattaaaggtggtccatgcatggactaatgatgagaatgttcattaaccaaagaatttgaataatttatttttttctctacctaaagttcaaaaataaagcaagaaagaaagcaactaccaagacagggacttaccttgccttaagacacactataagaatagacaaacagatcagtgggacaaaatgcagatctcagagatggatgggaatttaatatataataaaggtgtaaccaccaatcaataagaaggtattcattgttaagtagattagttgagaaaactgactcaccacaaggagaaaaattaaaactagatttgtacataatactgaatacaaaggggactcaagataaagacctaattatgaaaggtaaagttatgaaactaatttttaaaatataagcaggctgggtgtggtgactcatgcctgtaatcccggcactttgggaggctgaggggggcagatcacttgagcctagaggttcaagaccagcttgggcaacatggtcaaaccct

SEQ ID NO: 6252 - DNA, 456 bp, Homo sapiens
tcacgtacacaacatgtgctgtgaatgtttgagccttgccctgctttctggctactcagatcctctactcaggagagagcctctacccatgccacttgggaggagagggatgtgcttaagcatgttcctatggtatgctgcttaggccccaaggaggaagcaggcagacactggggaagctacctggaggggtgcctggggagtagacctgcctgtcagcccatcacctccccagcctgtgcaggtcctgggcttgtcatggctctgtgggttccatttctactccttagccaggcagtcgaacccttctgcagctccaccactcctgccccacctgtactcatgcctttgcctgcacatcctccttcctttttcactcccctctccccttttctaacaccttggtgcagaggtgggagaattgcttgaggccaggagtttgagactccgtcttgg

SEQ ID NO: 6253 - DNA, 578 bp, Homo sapiens
gcaagaagtacacgcatccacaattgtagtaagagatttcaacacacctctcaataattgatagaacaagtagacagaaaaacaaccatcttggcctaattgacactacccagcaacacaatacttggaacatttaccaagatagaccatattctgggatattgagcaaggtgtgatatacgtatagaaattcaagtcatgcaaagtagaatagaaatcaataacagacacttggaaaaatctccaaatattataaaaaactagcacacttcccaataccttatgggtcagagaaaaaaatcaaaaggctattttgaactgaccaaaaatgaaaatacaacagtgtgtggcatgcagctgaagcagtacttggaagttttatagcattaagcacctatattagaaaaggatacaagtctcaatgactttagcttccatcttaacagaaaaagagcaagttagacaaagaggcagaaatgaaatattaaataccagaacagaaatgaatgaaacaaaacagagaaaataaagctaaaagctgatttgagagatcaataaaattgataaacctctagcca

SEQ ID NO: 6254 - DNA, 330 bp, Homo sapiens
ttcacagctttaatgatcactgttcctatcgggttatttatatttcacaactaaatcttatatatctggaggcgcccttgggatatccaataaggacagctgtttttatgctgctattgttgccgtggtcaccggccatgtggtgctggccctctttatgtatgtggtctggaatgaaggctcatgacagtgacatgaaggcaaacaggattaaagtgaacatcaccttttgatagcattaaattcattttttaaaatgataaatgctggaggggggacatctgatttgaataaaattgaaagaacatgttaaagtcagtcttaaggagt

SEQ ID NO: 6255 - DNA, 3177 bp, Homo sapiens
gtgtgactctgtgccagagcaattgactaaaactctcaggttttagatatcaagccaccggggacttcatgagccaagtcccttccattcctttccaggtgcatagaacttcccacaagagtgtcagcactgtgctttcatcccgagcatcttgtttctgtcattcttattcttctacccatcttcacagcaatcattttcttcacttttctttttttttttttttcgtcttggccattgcacaccctaagacaaagcaatccattttcgttgttgttgttgtttgtgtgtttgtttgttttttgagacagagcctcgatccatcatccaggctgcagtgcagcagcgccatcatgactctctactgcctcaacctctcaggcccgagcaatcctcccagcttcctgagtagctcgggcctcagggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgccc

SEQ ID NO: 6256 - DNA, 3785 bp, Homo sapiens
ttccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacc

SEQ ID NO: 6257 - DNA, 3856 bp, Homo sapiens
ttccaccttctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggttacagtccagtaccgccttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccaccccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccaggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccacctctggggcattgtacaagttcttccctctccctgaagtgcctttcctgctttcttcgtggtaggttctagcacattcctctagcttcctggaggactcactcccccaggaagccttccctgccttctctgggctgtgcggccccgagtctgcgtccattagagcacagtccacccgaggctagcaccgtgtctgtgtctgtctccccctcagaggagctctctcaaaatggggattagcctaaccccactctgtcacccacaccaggatcgggtgggacctggagctagggggtgtttgctgagtgagtgagtgaaacacagaatatgggaatggcagctgctgaacttgaacccagagccttcaggtgccaaagccatactcaggcccccaccgacattgtccaccctggccagaagggtgcatgccaatggcagagacctgggatgggagaagtcctggggcgccaggggatccagcctagagcagaccttagcccctgactaaggcctcagactagggcgggaggggtctcctcctctctgctgcccagtcctggcccctgcacaagacaacagaatccatcagggccatgagtgtcacccagacctgaccctcaccaattccagccctgaccctcaggacgctggatgccagctcccagccccagtgccgggtcctccctcccttcctggcttggggagaccagtttctggggagcttccaagagcacccaccaagacacagcaggacaggccaggggagggcatctggaccagggcatccgtcgggctattgtcacagagaaaagaagagacccacccactcgggctgcaaaaggtgaaaagcaccaagaggttttcagatggaagtgagaggtgacagtgtgctggcagccctcacagccctcgcttgctctccctgccgcctctgcctgggctcccactttggcagcacttgaggagcccttcaacccgccgctgcactgtaggagcccctttctgggctggccaaggccggagccagctccctcagcttgcggggaggtgcggagggagaggggcgggcaggaaccggggctgcgcgcagcgcttgcgggccagagtgagttccgggtgggcgtgggctcggcggggccccactcagagcagctggccggccccaggcagtgagggccttagcacctgggccagcagctgctgtgctcgatttctcgctgggccttagctgcctccccgcggggcagggctcgggacctgcagccctccatgcctgaccctccccccaccccccgtgggctcctgtgcggccggagcctccccaaggagcgccgccccctgctccacagcgcccagtcccatcgaccacccaagggctgaggagtgcgggtgcacagcgcgggactggcaggcagctccacctgctgccccagtgctggatccactgggtgaagccagctgggctcctgagtctggtggggacttggagaacctttatgtctagctaagggattgtaaatacaccgatgggcactctgtatctagctcaaggtttgtaaacacaccaatcagcaccctgtgtctagctcagtgtttgtgaatgcaccaatccacactctgtatctggctactctggtggggacttggagaacctttgtgtccacactctgtatctagctaatctagtggggatgtggagaacctttgtgtctagctcagggatcgtaaacgcaccaatcagcaccctgtcaaaacagaccacttgactctctgtaaaatggaccaatcagcaggatgtgggtggggcgagacaagagaataaaagcaggctgcctgagccagcagtgacaacccccctcgggtcccctcccacgccgtggaagctttgttctttcgctctttgcaataaatcttgctactgccc

SEQ ID NO: 6258 - DNA, 292 bp, Homo sapiens
catgactctttcatttgtccccagaaaatcgcaaacaccttggcctgcagctccagctccccggctgagatggtgcagtgccttcagcagaaagaaggagaagagctggtccttagcaagaagctggtatggccacccttttggggatggtgccgggcaatggcacagagggggttctatccatcccctgcaggagcagaggggcagtctacccccaggtggggctggggacagcagctcatgaggggaaggggctgagggcttggagacagaaatggagggccatctccat

SEQ ID NO: 6259 - DNA, 474 bp, Homo sapiens
acccaaggggctggatttgactagacagccatcttggctcgtctcaccataaatttatttacacaaagctccatgggcactcagccactgtctatccagcccatttatcgagtagttatcccctcactctcctgtgtcatcagtgctctctttatgcttgctctttctatcagcacacatttgtgatatatttctcatctttataaatgaaaacctcatttggcccctcatccctttccagctcctgtctcattgctcttctcccatttatagcaaaagtcttctaaaaaaaattgttgcttagattcactgtctttatttctttagtagttatcccctcactctcctgtgtcatcagtgctctctttatgcttgctctttctatcagcacacatttgtgatatatttctcatctttataaatgaaaacctcatttggcccctcatccctttccagctcctgtctcattgctct

SEQ ID NO: 6260 - DNA, 476 bp, Homo sapiens
tattactgaattatataacatttggagatttcccagttatatttttattaatgtactaatttatgtcctccatgttaaaacaacagagtctgtgattttaatctactgaaatgtgttgagaaatgctttatgtcccaggatctggtcaattctggtaaatgtttcaagtacattaaaaagaatacagttcttgggcacagcattctacattcatccatttccagcggtttgctaatattgttcatatcttctgcagccttactgagttttgatatcatgttggtattattgataccagtattacttattcttcttcctgaaacactaaaatgaatcattttgtccaagcacggtggctcatgcctgtaatctcagcactttgggaggctgaggtgggaggatcctgagtccaggagttcaaggtcagcctggacaagagagcaagaacccccatctctacaaaaaaaaatgaaatt

SEQ ID NO: 6261 - DNA, 322 bp, Homo sapiens
ttacaatcttatgggaccactgtcctatgtgcagcctattgttgattgaaatgtcactactggacacatgactgtgttgtctaatttgtatatttgttcctagcctgtgtctcccctccagagtgtaggtccctgagggcagtcacctgatctgtctcagtcactgcagtgtccccaaacagagcaccgcctcaggcacacagaggtaagcatgcatcgatcacaccaacgatgcaggaatgtcctgacacaccaggcagctgctgtgtgttctcgggctggttacttaacttgcaggagcctcaggagcctcattggtcaa

SEQ ID NO: 6262 - DNA, 919 bp, Homo sapiens
tgttttcagtagggatggggtgtttcactatgttggccaggctggtctcaaactcctgacctcaggtgatctgcccaccctggcctcccaaagtgctgggattaaaggcgtaagctaccgtgctggggctaaatatattttcttgtgctctggagtatttcagagttactgaatgaggttaactaattcatgcagggcttttacttttttttattattatacttaaagttctgggatacatgtgcagaacgtgcaggtttgttacgtaggtatacacgtgccatggtggtttgctgcacccatcaacccatcatctacctcaggtatttctcctaatgctattcttcctctagcccccacccctcaataggccatggtgtgtgatgttcccctccctgtgtccatgtgttctcactgttcaactcccacttatgagtgagaacatgtggtgtttggttttctgttcctgtgttagtttgccgagaatgatggtttccagcttcatccatgtccctgcaaaggacatgaacttatcctttttcatggctgcacatagtattccatggtgtatatgtgccacgttttctttatccagtctatcattgatggacatttaggttggttccaagtctttgctattgtgaatagtgctgcaacaaacatacatgtgcatgtgtctttacagcagaatgatttataatcttttggatatatacccagtaatgggattgctgggtaaaatggtatttctgcttccagatccttgaggaatcgccacattgtcttccacaatggttgaactaatgtacactgccaccaacagtgtaaaggggcttttactttttaatgaaatttatgagtaagggaatgaaatgacatctgtgtctttctcctgaaattcaacacactccacctgtac

SEQ ID NO: 6263 - DNA, 398 bp, Homo sapiens
tgtctttttaatataaaaggtgttaacagctatgtattgttctgcaaatttgttagtctgtgtgtcctgcaggctctttatatcagggcatatatacttacattattaattttaatagctatatgttatccagtagacttagaataaaatcccaaattcttacttgatggcatctatggagtatggccacctcatctctcattgcatcctcctccttacccactcctttctgctcacactgggctgtgtcttgatgtttctgggaacacgtgggaacacaaacccacctgtctccttggactgaggaaggctccagtccttcaatattttcttgcctcatttccttactttattcaagtctctactcaaatacagcctcatcagaagttccttgatgt

SEQ ID NO: 6264 - DNA, 793 bp, Homo sapiens
tttattttgtgtttttacaacatgcaggtgctgctccaaaaaagtttttcaaaaaaaaaaaaagagaaagaaagagagagaaagaaaaacatgtattgcagtgagggtatttatgttcaaagttcagaaatttgtgggcattaactgagacctggaatccctgccattcagctgaccctctgccctgcccaacattcttcactgttaaatgcctaagaataatagcctcctccacctgcaccccagcaaagtgaaacatatttccctggctgggttttaagtcaagctaaacaccagcagacctaagcgtggtacctgcatcacttggccgtccagagaaagagacacactggctttgaattcttttggaacttctttgagccagaaaatatcgactcctagcaggcccagcacaggcgctgttgtacatgctctctgggtctgtactgatcaatgacaattttggtaaacactgcctgaataattcatcatagaaaaaagctttcgaattaaatgatattactggggcttccagcacaaacacacacgtgttcccgaaaagctagtccagctggaagactgcttggaataaccacgatgatacccaagctaagccccccattttataaattgtaatgagtcatctacctaccctaccctcagtcataggaaaatgctgttggagcctcagccaggtgttccagcagcatgcacctggcacatcttgctatggcttctcatggtaaaatgctaccatggttaacccaacgcggcagcatgcagcgatctaaaa

SEQ ID NO: 6265 - DNA, 694 bp, Homo sapiens
cctcgctttctattctgagctgaatgggagcagaatatttctatttttacatttttgatagttatgagaaaacatcaaaaaaataaagcactgaaaatacatagatggcaaaaattattatagataagattacatgcataatttctttgcagaaaagctctggtattaaacaaaactgaagaacatttccctgacaaacattttttcaatgactttaatcattcaatactacagcataataacaacttccttgattgatggatagtgtgccccaatactgcttgtgataaatataatataatataattaatgtaatatcatattctgttttgatatcacttggtgcatttctgactgtatttaagcttagagaaaatttgctagtggtaaggaggaaaaagaagagtctcttgtactttgattgtaaactggacaacataaatggatgaagatgaattctgactgggtttataagaaactgaagttctaagggtaaagttagatggctattgtctctgaaaactttaggtgaagaacctcttttttttgaggttgggtatcctgaaaaactgaattgtcacttctgtgcttaattaaacctgaaactgcaaagataaaaatgtgttgtcatcctagatcaactaaatctgtcagaaaaaaagtacaaaataaataaaaaatggaagaaaatgtc

SEQ ID NO: 6266 - DNA, 465 bp, Homo sapiens
cgcccagacctaaactgtcaaatacttaagacttagaaagagcgatgaaaacctctttgaacatacagctttcagtatttgttttggagacttgaattttgttttaaagagcctcggataaaggttattttatttttatttttatagagaccaggttttgccatgctgcccagggtggtctcaaactcctgggctcaatccatccacctgcctcgcccttccaaagtgctgagattacaggcatgagccactgcacctggccaagaaattattttgttatccaaaataaatgcagtctttttcaggccatcagttcatattcctgtagtagatttatatttgaagttcttccgatgcctggcatattcataatcatggttcttccctgttaaagtaatcacctagtctataagtacaagttcaagattgtcgcaaatttcttcttgaatagaatctagagatcac

SEQ ID NO: 6267 - DNA, 914 bp, Homo sapiens
catcacggtgattgtcaactgtcatggcaaccagtgggaatgtcatttagtactgaagttggattagaatgaagctagaggttcttcagaggtcgagtaagctaagaaggaacctatgaccacagacaacctgttttctaaaaataagcagagttaaatctgagtaggaatttagctatgtcatggaggcattgcattgggtaacaaaagccaggtaggcgtccagctaagtcccctaggccctgcaacgggtaacagcagtactgactctatgttagagaaaagcttgcttgcttgagtataattattgttttgcctgagtttgtaaactattcactaaaaacagccacagaaaaaaacaggaccttcttcaacagataaaacacacagacccgcagctttgggaacaggctgatggcccctgcacagtctagtcacaaggcattgaccaagaaagtaatgactaactgcccatctgagactgtgcatgattcacaagaatgtttctttgttttgttttttgagacagtcttggtctgtctcccaggctggagtgcagtgatgttggttcgctgtagcctctgcctcctgagtagctgggactacaggcgtgtgccaccgcacctggctaatttttgtatttttagtagagatgatgtttgactatgttggccaggatggtctcgaactcctgacctcaagtgatccacctgcctcggcctcccaaattgctggggttacaagcatgagccaccgctcctggcccacaagaatgttttgatcattatttctcctaattttccttaaaatccctggatctagaggcacaactgagaaaggtggtctttgaatgctagtgcactgccttttgcaggttgctggtttctcgaataaagctaactttgctttcacca

SEQ ID NO: 6268 - DNA, 424 bp, Homo sapiens
aaaaaaagggagatgctcttaaacacacacttgtttccactgggtaacagtaagaaatgaggaatttcatttaagccttactgcttcctacaaattgcataatattagattacaccaacatgcaattggccaagtttttaaaaacctgacttgtttttggttgtggaaaacactgttaataaagaagagttatttttgctatgggatggtggctttggagtgttgatttgactgctctgttgactttgaagtaaattcaaagtaaatacattttggttgcatctgagaacaggtgcgttttgagattctccgtgttggtgtagttggggcagggctgccttcacaatgtgctgtgcatggtgaccatttgctcccgtgttcacgttttgcccaatgctctgtcacatgaatgccgttcaagctc

SEQ ID NO: 6269 - DNA, 290 bp, Homo sapiens
tttttgtagagatggggtcttgctctgttgcccaggctggtcttgaactcctagcctcatgcgatcctcctgcctccacctctcaaagcatgaggatataggtgtgagccactgtggccagccctcatttaacatttattgagcattaacccctctgctaggcactgggtgtgtgctgaatatgacttggtctctatactcaggtttgcagccataaagagatattatcacaattctaatatggaaacatctagacaacgccaccgtggtctgtgcaaatgtgctcctag

SEQ ID NO: 6270 - DNA, 463 bp, Homo sapiens
aacacagggcagagcttttctgtctgtggagggggcaccagggaaaactttgcagagatggtgccatttgaatcaactcaatcttaaagaattcctcttgaatttttcttcaagactgatttggatgaaaatggctatacttggtcctcgtgaggaatcaatgacataataaaagtatgctaaaaagcataaaaaacaatataaatagtctattagtaatgaaatgattcatgggcatgaatattacagatctagttctaatttttgattgcctgtttattaatgtttttttctttttgataatgaattatgagtgcagttatttgagaactgattgtaagactgtagttaaaagtgggagaggccaggcacagtggctcacacctgaaatcctagcactttgggaggctgaggtgggaggattcaagaccaacatagcaagaccctgtcttaaatctaaaag

SEQ ID NO: 6271 - DNA, 372 bp, Homo sapiens
gaggctgtgtggcagtttaaacacagtttccactgccttccctttccctaaagagtaaacacaggagataatactttctaacaactcatcgttatcaagggcctactatgtgctgcttgttttggctgcatgcgtaaacacatctcagacattgtctcactggatactgttttaaggagcctaatgtggccccagtaattatgaaaacctttgaaatgtctggatctctaagaaattagaaaaaggagggaatggctgagcatgggggctcatgcctgtaatctgtgttttgggaggccaaggtgggaggatggtctgagcccaggagttcaggaccagcctgggtgacatagtgagaccctgtctgtacca

SEQ ID NO: 6272 - DNA, 1545 bp, Homo sapiens
  misc_feature (432)..(432): n is a, c, g, or t
  misc_feature (439)..(439): n is a, c, g, or t
  misc_feature (544)..(544): n is a, c, g, or t
  misc_feature (652)..(652): n is a, c, g, or t
  misc_feature (682)..(682): n is a, c, g, or t
  misc_feature (738)..(738): n is a, c, g, or t
gcctctcagggttcttggtgggaccatagctcagatggcagcaactgaaaggacagaactgctgcccagatgagatcccatgatgtgtgttctaaatcggcctttagtaatggtgcaggtggcctggtgccctcagcctcaccgcaccacccttttgccttttggtgatgaggctaagtacatgcttgccatatgttgaggtgggggtgggtcagtgcctctccaggggtgagtagttctgcactggccctgcgtatgggtgaggctaaaggaggaggccgcgcagtggggcaggcaacatccaactgctttagcctttttgcccacgtattttcaggatattggctttcagattgcaggtatatgactctgcttgatttttgcagttggcccgatgtgcacctcagccattttctattgattctgtagaangggactnaaacttacattcagtagaaaattacgtgtgtgtccatatgcctatctgtgcacacacacacaaatatatttgtgtgtatacacatatatgcaaatgcatggaaangtaggagggagggaagtggaactggttggggtggggtggtgctgaaggagaactttaatattttattttaaatacttatttttttttgagacggagtcttgctctatngcccaggctggagtgcagtggcgcgatctnggctcactgcaagctccgcctcccgggttcacgccattctcctgcctcagcctccngagtagctgggactacaggcgcccgccaccatgcccggctaattttttgtatttttagtagagacggggtttcaacgtgttagccaggatggtctcgatctcctgaccttatgatccacccgtctcggcctcccaaagtgctgggattatgggcgtgaccaccgctcccggccattttttgtgtttaaattttttttttttttaaatcaaaacaccagaaacccctctgtgtagggcagaggttcttaagcagtgaggggcacctgcaggatctgttccagcagacagctggccccaaatcctggctttctgggtcaagagggctgggtggggcccaggagctgcctctcgaacaagttccagggaggctgctgaggtggggcctgcccttcagaagcccgggtctggtggagagactgggagagtcctgagtgactcgtctgcatttgcagcacctgtctgaagagaggcatggagattagagctttcttctctccctacaaccccatcctctttctgagcatttcccagctgcacgtggctgtgaggaacacggggcctgcagtatttcaggagtggctgtatcaatgtgttttctctttttagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatc

SEQ ID NO: 6273 - DNA, 513 bp, Homo sapiens
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatc

SEQ ID NO: 6274 - DNA, 847 bp, Homo sapiens
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacacagggagtgagcctgcggtcggcctgaggtatcctgcaactgcaagcactaaataagctcctgactcatctctcccctgtggctgatgcagaagctgatcctggagaaactaaaaccttctgcacagcaaaggaaacaatcaacagactgaaaagacaacctacagaatgagagaaagtctttgcaaactattcatctgacaggggattaacatctagaatatatgaggaactcaaacacctcaacagcaaaaaaagaaacaacctgatttttaaaatggacaataatctgaatagacatttcttaaaagacacaaatggccaacaaacatatattaaaaaaagctcaacatcactaatcatcagaaaacacaaatcaaaaccacaatgaggtatcaactcacctcagttaggatggctattatcaaaaagacacacacacaaaaatgctggcaaggatgtggagaaagggaactcttatatgatgttggtgggaatgtaaactagtacatcaactatggagaacagtacagaggttcctcaaaaaactacaaacagaattacctcatgacccagcaatcccactactggtgtttatccaaaggaaagga

SEQ ID NO: 6275 - DNA, 412 bp, Homo sapiens
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctaggtatgtacccacagctggcgctgcatggccagccaggtggggcccactctttaatggaaccatgaagcaagtcccttcggaagtaaagcatctttatgct

SEQ ID NO: 6276 - DNA, 337 bp, Homo sapiens
ctgcataggagcccaacatcaccagcttaccacgtattggtcattctctttgaggagcagggccatactgacggcttacatgtgcgctctggtggaagtaggatgtttggtggcagcaggagcaaaatcaactctgccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatc

SEQ ID NO: 6277 - DNA, 846 bp, Homo sapiens
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtaacgtgcatcctcaattagaattaaagtgatatataaataaaaaaaaagtcgacgcggccgccaatgtaggggtcacagtctacccgctaattccggaccgggacctgcttgcgaac

SEQ ID NO: 6278 - DNA, 1878 bp, Homo sapiens
  misc_feature (432)..(432): n is a, c, g, or t
  misc_feature (439)..(439): n is a, c, g, or t
  misc_feature (544)..(544): n is a, c, g, or t
  misc_feature (652)..(652): n is a, c, g, or t
  misc_feature (682)..(682): n is a, c, g, or t
  misc_feature (738)..(738): n is a, c, g, or t
gcctctcagggttcttggtgggaccatagctcagatggcagcaactgaaaggacagaactgctgcccagatgagatcccatgatgtgtgttctaaatcggcctttagtaatggtgcaggtggcctggtgccctcagcctcaccgcaccacccttttgccttttggtgatgaggctaagtacatgcttgccatatgttgaggtgggggtgggtcagtgcctctccaggggtgagtagttctgcactggccctgcgtatgggtgaggctaaaggaggaggccgcgcagtggggcaggcaacatccaactgctttagcctttttgcccacgtattttcaggatattggctttcagattgcaggtatatgactctgcttgatttttgcagttggcccgatgtgcacctcagccattttctattgattctgtagaangggactnaaacttacattcagtagaaaattacgtgtgtgtccatatgcctatctgtgcacacacacacaaatatatttgtgtgtatacacatatatgcaaatgcatggaaangtaggagggagggaagtggaactggttggggtggggtggtgctgaaggagaactttaatattttattttaaatacttatttttttttgagacggagtcttgctctatngcccaggctggagtgcagtggcgcgatctnggctcactgcaagctccgcctcccgggttcacgccattctcctgcctcagcctccngagtagctgggactacaggcgcccgccaccatgcccggctaattttttgtatttttagtagagacggggtttcaacgtgttagccaggatggtctcgatctcctgaccttatgatccacccgtctcggcctcccaaagtgctgggattatgggcgtgaccaccgctcccggccattttttgtgtttaaattttttttttttttaaatcaaaacaccagaaacccctctgtgtagggcagaggttcttaagcagtgaggggcacctgcaggatctgttccagcagacagctggccccaaatcctggctttctgggtcaagagggctgggtggggcccaggagctgcctctcgaacaagttccagggaggctgctgaggtggggcctgcccttcagaagcccgggtctggtggagagactgggagagtcctgagtgactcgtctgcatttgcagcacctgtctgaagagaggcatggagattagagctttcttctctccctacaaccccatcctctttctgagcatttcccagctgcacgtggctgtgaggaacacggggcctgcagtatttcaggagtggctgtatcaatgtgttttctctttttagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtaacgtgcatcctcaattagaattaaagtgatatataaataaaaaaaaagtcgacgcggccgccaatgtaggggtcacagtctacccgctaattccggaccgggacctgcttgcgaac

SEQ ID NO: 6279 - DNA, 998 bp, Homo sapiens
ggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtccacttccacgtcatgcggctgacggactcgctgttcctgtgggtgggggccacgccgcacctgcgcaacctcgccgtggccatgtgcagccgctacgactccatccccgtgtctacctccctccttggagacacttccgacacgacctctactggccttgcccagcgcctaggaaggactgtcctcactcagtgtgataccgttcagggctcggagggaagactggcctggcctgtgagtgtggcgtagagtggggattaagcaaaggtcatgaggctgaatgctccactcttcccacaccccaacacacttcctgtgggccagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtaacgtgcatcctcaattagaattaaagtgatatataaataaaaaaaaagtcgacgcggccgccaatgtaggggtcacagtctacccgctaattccggaccgggacctgcttgcgaac

SEQ ID NO: 6280 - DNA, 501 bp, Homo sapiens
cagctgtggaagagtccaggcactcaggcgtggcatcttggttcaccctttcttgcttccgaggctgcattcaagccccaatgagaacaaaaccatgtgtgtggggaggggcgtggggggtgtcggcagttttagtttttcagaagtgacgtttgttggcagatggctccctgtcctccaggcagtcactcatggactggccagtggacaggccctttctataagaacccagccagccttccctctcccaaaccctgtcactgcctgggcttcatccagggagctagaaatagggtttgcactgatgtgtggaagcagcctctccttgccttctgtgctcctcctgtggctgcaggagtgtggctctgggtgtctgtgtgtggtggacggtaaattcgctgcccagtcaggtcccacaaggccacggggctcagtcacagccagtggggagaaccatggtgagccatgcaggttgagaacaggaccagtgcatttgcgaga

SEQ ID NO: 6281 - DNA, 733 bp, Homo sapiens
gctattttaccaacattgatcaagctctggttgagccttgtacaggatattataggctttaaaagaagaagaagaaagacctggtatgctgtacaaaaaactgcaaaccaggcacgcagatataagtgttacaagaatccagaagaagcagcaaggagatggggctaggagtttgtaagcagggaactgtatctgtaatatgtaaatgaagttactgggcatctcttcaatggtcagtgtgagtggaatgtgtgggaaaatgtagtggtgagaggtgagataaagagaagtagacagggacgaagtcacagagaggaccgtgttgggaagtttggactctctattctgtaggtagatgaagtatttaaaagaagaggccatgatatagtaatatttggtttaatgtggtatggttgtagtgtgtggcggaaatttgagaggaagaattgtcaacttgcagggcagcagggaagccatttgtatttagctagaagaacatggattgaagcaatggatgatggatttcagagcaatttgtgaagtagaaccagaattttgtccgtcgaacttggggtgacgaagcactatgcctcagataaaggtactatcttctagggaattcaaacggacctaagctgctatttgggcagttgagaccaagagaggcatcctggtaatagtgctgtgcttcaagacaaaagacattaaaatatttttacattgcaaaagtttt

SEQ ID NO: 6282 - DNA, 583 bp, Homo sapiens
tgtcaggggctcagcgctgaatcatcagagcctaaagtgtctgataaatactacttattcattcatccattcatttactcaatcattcattccacagataatccctgagtgcttattctgtgctgggtaccatgctagttgctgaggatacaacagtgagcaaagccaagtacctgctgtcagaccagccactcattctgtgtgtgttcaataagtgatcaacaggaagaggaatgcctattcattctcacatatacttttaatgatgagcattgccagccaatagactggctgcctcatgtggaggtgagctccccatcacaggaagtattcaataagatcctggataagaaagagcccattgtcatgatgctgcaagtggaggctcctgaaggtccctcttacctccacgattctctggttctctggaggatgccatcgggtggctgctgttgtgtggctgtcagagtccggcagcagcatgcaaggtagacatctttgttttttcctgatggaaccaactggcttctcttgaaaaccagagctaaacacttgcctttgatataaaataaattttcattta

SEQ ID NO: 6283 - DNA, 582 bp, Homo sapiens
ttctcacctgctagttgtcccttaacttcaatttcccactcttccctataggatcttagaaatactaaagggaacatctaatattcacaattcctgggcctgagcaccccctgggcacacagagataaactgctatagccctggaagaaatcagggctctgggaagccggggtctaactaaagttagcaccaaatccctgaacttccctgtgtgtactatgagacaagaactgtgggactttcctgacttgggcaggaaaggagcttggaagaatgagagggactgggtggcaagctctatcatcaaacaggcgctgcaggggctctgcagggctgtccccagacaggtacatttggaagggagggagatgaggtagggacttggcagatgcccagtgggtgtaagtcagtggccacacagtgagtgtacaggggctaaagggcagccacttgaaaaaatgtgctgttcaactgaataagttcacaaggaacaatccaaagattactaaatatcaattatttgtgttgcctgaattgtcctccaatcccaataaatatcatgcgtgcatttcaacagggatt

SEQ ID NO: 6284 - DNA, 174 bp, Homo sapiens
ccttcgcaactgaaaagctgatggagctggattccctgtttgtaaaggcatgaattcctggtggctccaccccattcccccagcgtgcatgtggggccttagtgggctgcaggcatgtttaggcaagcccctgtgcaagttcccttatctgcacaaaacatctcatgtaaccat

SEQ ID NO: 6285 - DNA, 323 bp, Homo sapiens
gagcccaacagattagaaaataattgccacggaaaagacattttgtggcagggcacaatgtctcacacctatactcccagcactttgaaaggctgaggcaggaggatcgcttgagcccaggagttcaagacaagcctgggcaacatggcaagacaccatctctacaaaagatacaaaaattagctgggtgcattggcacatgccgtcccatctacttgttaggctgaggaggaaggatcacttgagccctggaaatggggttgcagtgaggcaagatcatgccactgcactccagcctgggtgacagagcaagaccctgcctc

SEQ ID NO: 6286 - DNA, 588 bp, Homo sapiens
ccagactgagaattgtcagtctacagtatgataccccaagtatctctcatgagtttgatatttttgtgataccttattcttcactcttagtaggtttatttcaataaagtaaggctttgcttatatgggagggcagtgcattaagctaatgcaaattatagttgataaactaccttctcatgtatcgctgaatgccagggagcatttttgttgggggcagtgctggcgggagttttgatggaagtaatagtagagagatggagagtacacaagacctagaggagggttgattgaaccataaggaaaaacagataaaagggaaggtgagaggaattgaagacaattatcatttttctcatacagcctcatttagcaggctgagacttggctgtttcgggagtacctgctgcctctcactagaaactgccatctttatgctatcaccctgtctctcatccagtcttacctacctgaggtataagacctggactcaccacttgagttatacatggctacctgatccatctcttcaaagtcatattaaatactataagattctcagatttaatctgtcaaaacctaaatagt

SEQ ID NO: 6287 - DNA, 902 bp, Homo sapiens
gaaggtctcccaggagctctgtactgaggcagacacagaaagacacaaaacggtcgtctttcctgcccaagtaaagcttacagactaactggggagatgtagtgtgcatacaaaacagtaaaagagccatctcaaggacagagagcatagaccaagtcatctggaatggtctacatgccatgcggaagtccaccgaagggttagaacagggtgtcccagactctctcttctgagggaaggttggttgcaaaagtgggattcatgaccctcccaggctacaccatcttctttagaatgagaactgccaggtgacgccctcgctgctcctacctggctactaaacatcgacttcggttcacttcacggatgttcagtggatatcggtcacatgccaggtccccagctacgcattcaaggatggataatatacatagcagcacatccttgaggaactcataccttggtaaagggaaagaaatccatgaatggatacctctgtgtcctaagtgtttgtaataatgctgtgtgtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaagcc

SEQ ID NO: 6288 - DNA, 694 bp, Homo sapiens
caatgaaaggggtacatcttccctgacattcattcagaaacccataacctcagtctaatcatgagaaaaacaacaaacaacataaacacaggagcaaaattcgaggaactttctacaaaacacttgaccctactcaaaattgccaaggtctcgaaaacaaggaaagagatgccgtcacggacgagaggagactaagcagatacgatgactgaatgccatgtgggatcccgggtgggatcccgaaatggagaaaggatattagtgaaaaaactggcaaaatctgaatacaatttggagtttagttaaaagtaacataccaatgttggttccttagttttgggaaatgtccagtactacagtaatgtaagatggtaacattagggagagctgaaatcgggtgagggctatgtgacgaatttgtactatctttgcaactttactgtggatctaaaattattccagattaagaagtttacctatataaaaagcatatgtacatcataattacagttatgcaaaaatatggttagaaaaaatacataaggaaaacatacgtaaaaattagtgtggttctgttagaatggtggcattgtggagtattttttcctcttatctgcttactgaattagctgtaaatgagtcattttccataaattaaagagttaattttagagattcttttccttgaaataca

SEQ ID NO: 6289 - DNA, 653 bp, Homo sapiens
cacattttcagaaaagcaggagggaggagagcatcacaattcattttatgaggacagtattactagataccaaagccaacacaaaggcatcccaagaaaagaaaactagcagccagtattcctcataaatgtagacacaaaaatccttagcaaaatattagcatgtttaattagcaatattatatttaaaaggataatactataatcatggtcaagtaggatttatcccagcaatgcaaggctcacttaacttagaaatatcaattctgtgtaatataccatactaataagatatatttgaaaaaaaagtgatcatctcaatagatgcagaaaagtatttgacaaaattcaatacaaattataataaaaactcttagcaagctaggaattgaaggcaacttcctcaacctgataaagaatgtctgtgaaaaaaaaaatcatacttcatggtgaatgattttatagttttccacttaagatgaagaacaaggcaaggatgtttgctcttactgcttttattcagcattatcctggaggtcctagctaatgcagtaaggcaagaaaaagaaatttaaaggatatttggaatggaaaggaagaagtaaaaccaaatagatggcatttatacagaaagttctaaagaatctaccaaa

SEQ ID NO: 6290 - DNA, 497 bp, Homo sapiens
tccagcctgggcaacagaatgagactccctctcaaatcaaaaaacaaaaaaaaacccaccatgagaagtcacagcaggtacaaatgcagtgagggggaagaacatagcatgcttggggaacagagatggtcagtgtggctggtgtgtgggatgcacaagggaagtgccaggcgacagtactgggaaagcaggtaggaagcaggcagtctgggaagggccttctgtgctgcaccaagtttagattctgtcctcttggccagtggttcttcgtatctttccttctgccacaacatacgtataagatagctgctactgcctgccacagataagactgtggccagttctgagctgtactgctgcgtctcccttctcccacaagaagttgagagaaaggcaaacaagaaaccttattagaagggtaactttaaaaccaccagcttctttttaaaaaattaatggcatataataacatacactaaataaaagattaaaacagc

SEQ ID NO: 6291 - DNA, 141 bp, Homo sapiens
atcctgctcagccccagctctttttcgccatacaagtaggaaggcccatgattttctgtaattttaaaaaagagaaatcagaaatctctattcttattcaaaatctcccaattgttagtgttagaaactaattcaagatgt

SEQ ID NO: 6292 - DNA, 1109 bp, Homo sapiens
acggcccttaggatagcaggattccctgaagagggccaaaggggcaggagcgcagccttagtggcagtgctggtccatgaggctctacaaagcaagggatgggtgtttgggaggaggaaaaggctcttgctgtactcctagaggttggaattaaagtggaaaagccagaaaattcaagtcctttactaacatgtctggagattagaaggtatatgtacatgggggagaagccaaaattattgctgcgagtggtcagcaagaaaatcaaggctcttttcattattttgagcattcctctgatatttgaaaaggaagtacaacaggaaaggaagtctgaggatggaagctaaaattggtatgaatttatattttagagatcaaaatgtaccttatgttgaaacctatgtaagaagtgattatgtagaaagagtgaaagtgatagctcttagtctggaaagcccactggcttgtttgggcatttctcatggcttcccactcaaagtggatccccaaaatcacttgatggatttccttgctgatttctaagtaaactatggtttaagaaagaaatgacagggctcagcactgccctacagtaccaagaatacaaatgtttccatgaagtcttcaaaggcatttgtaaaattcaggctgtaagtgattagttagttcattctgcacttatttattaactgtatattcagttccaggctctagggtagagattatggataaaggtgaattagatagatgaagtttttgccctcacagcaaaagctttagccaataattaaagctatcactggaagtgggtctgtgccaataacctagagaagagcagtgcttttagagttgagctatattcccaatcagttcttaatggtggttttacccccttccctctacactgtcttttcttgagattggatcatgtgtgtgaacccacatcatttccagtcaaaatcaccaagagaggccggacacagtggctcatgcctataatcccagcactttgggaggcctaaatgggtgggcctcttgagtccagagtttgagaccagcctgggcgaccccagctctaccaaaaaaaccaaaaaacaaaaaatacc

SEQ ID NO: 6293 - DNA, 355 bp, Homo sapiens
gatggagagggtgcagctgacagagggagctcatgaatggtgggacctggcatggctcagggaaacttttggcataatagaaggcaaaccctcccttctagttcagaaatgtgtaattgctggagatgttagcttgctactgggtaaaatgattttaaagagagaacttctcaacatttaaatcagcctcaattttccatgttccttttcatcaagtcagctctggtttgagaagggatcatatcggcactcaaccctttaaatgattttccttctttgcctttctttttctttctctttggccttggctccttcctttccaaccactcccctcccagaacctcttattttagcc

SEQ ID NO: 6294 - DNA, 595 bp, Homo sapiens
atcacaggattccgattttaatacgcctcacaataggaattttggccttgaggccaagaattgggcacgagggttaattagtagctggagctgtcactgagccctgcatgttttgcactgtactcggcacatggtttattattgctatctcagacaaaacccaacctagatgtgtgagtttggtaatttattccaagttacgtcaaggaagataaggtcccggtgagatgagtaaattagcaagggggccagtctgaggtcttgtttggtagctgggactactgtgctcttgtatatgatcagatttggcacaggtttttagaatagcgtgtatacaagtagagggatctctttttttctttttattgtaaattgacaattacatatgacataaatgtatggggtacaaagtaatgttataatctataaatacagtgtggaataattaagtcaaactagttaacatactcatcaccccaaatgcttaacattttttgtggtgagaacatttgaaatgtactctctcagcaattttgaaacatacagtactctgttaactattcaccatgctgtgcaatagaactcaaaaaaagaa

SEQ ID NO: 6295 - DNA, 326 bp, Homo sapiens
ttgaccatctcaagagaacatggagaatactcacaaatgcttttacaatgacttaatttttatgttctggttgttacttctgtaatgtaacttctgttattgttcacttactttacaaaataagaagaccaaacctttttttaaagccccgttaatgaaagacagtaaacaggcagtgtggctctgagaggagggagagctcacaacatgaagagcgagattgttctagctacagggagtggcatgggaaaaaattactgtgttggagatgctggaggtattagagtgatttgaataaatggaatgaaggaagtggtttaagaaat

SEQ ID NO: 6296 - DNA, 922 bp, Homo sapiens
tgtgatactcttggtagatagctatattttaatgaatttattttgtggggagaggggaggttagtggaatacttttggaatctggaataaataacatgtatcaaataacgatacatgctttggaggattccttggtcttagaatccctgtgcaattctgtaaaagaataccaggttctctggcatgtagaagtgaacttgggcaggtggaaatggttaacaaagaattctaggagtagagaataaggtctgaatcctcttaggacagttgggagttacaaaaaattaacaaacagaaacattgagattggtgctttagaacttggagtaaattaagaataaagggaagtagacacctttaaaaaacaaagaaaaagaacttggtgagtaaaaatagaaaagacaaattatggagtaggaaataaaaactcaccagaaaagttgtcttttacctcctaagggaaaagctaaaggaattagagttgttttgtctaaagaaaggcaagggaagactcaatttgttgttgtcagttattaacaatttatataaagaatagtgtactatttcttttctgtctgcagagattgagcagaaatgctttcaattaaaacaaatagatatgagagaattgttgatagccggtaaaattatagactaccaaacctagcatgagccaccgcatccggccaatgttaatacttttttaagaaaaaaaattttaacctaccattttcataggctttacctgtgagcttgccttagtgctgaaccctgtgacttttcaaggcttcttccaggtctgtgtttctgcctaaaataaaagtttaaatcttggtgaagattgtctacagacaattctgaaaatttagttttccttctaccagaaagaaagaaaaagagagaaaagaatcttctaaaaaaa

SEQ ID NO: 6297 - DNA, 934 bp, Homo sapiens
tgtgatactcttggtagatagctatattttaatgaatttattttgtggggagaggggaggttagtggaatacttttggaatctggaataaataacatgtatcaaataacgatacatgctttggaggattccttggtcttagaatccctgtgcaattctgtaaaagaataccaggttctctggcatgtagaagtgaacttgggcaggtggaaatggttaacaaagaattctaggagtagagaataaggtctgaatcctcttaggacagttgggagttacaaaaaattaacaaacagaaacattgagattggtgctttagaacttggagtaaattaagaataaagggaagtagacacctttaaaaaacaaagaaaaagaacttggtgagtaaaaatagaaaagacaaattatggagtaggaaataaaaactcaccagaaaagttgtcttttacctcctaagggaaaagctaaaggaattagagttgttttgtctaaagaaaggcaagggaagactcaatttgttgttgtcagttattaacaatttatataaagaatagtgtactatttcttttctgtctgcagagattgagcagaaatgctttcaattaaaacaaatagatatgagagaattgttgatagccggtaaaattatagactaccaaacctagctgggcgtggtggctcatgcctgtaatctccgcactttgggaggccaaggcaggcagatcacctgaggtcaggagtttgagaccaccctggccaacatggcgaaaccccgtctctactaaaaatatgaaaattagccaggtgtggtagtcccagcatctcgctctgtcacccaggctggagtgcagtggcaatctcagcttactgcaatctccacctcccaggttcaagtgattctcctgcctcagcctcccgtcgacgctggtatt

SEQ ID NO: 6298 - DNA, 367 bp, Homo sapiens
ttggtttggcttcctagtgtcaattaaacttctaaaagtttaatctgagattccttataaaaacttccagcaaagcaactttaaaaaagtctgtgtgggctgggattacaggcatgagccaccgcatccggccaatgttaatacttttttaagaaaaaaaattttaacctaccattttcataggctttacctgtgagcttgccttagtgctgaaccctgtgacttttcaaggcttcttccaggtctgtgtttctgcctaaaataaaagtttaaatcttggtgaagattgtctacagacaattctgaaaatttagttttccttctaccagaaagaaagaaaaagagagaaaagaatcttctaaaaaaa

SEQ ID NO: 6299 - DNA, 1867 bp, Homo sapiens
accgcgaggggttcagatattctgaactgacctctctcttctgcagaggggtcatcgcatactcacacactgcatggctccccctgcctccatcacatttctccactgagcagggcttcccttgcccacagaggtgggtgagggtagcagcattggggttacggctgtggtttctttcacttattattagaataatagtcactggtgagacctgaggtagagatggagccgcctctgaaccaagcccacttggtttctttactgcactggttttcatgagaaagcaatttaatattaattctttaggatgttccagcttccctcagtgcattcccttgcagccagttttgctatctgcttagcgacctgcccattgtcattgaagtgtggcttctggggggagcgtcatatcttccattccatctcctgctttagggaaagacagtttttagtccaggggtttttcacctaatgactggatttcaaagccaagatgctgcagttgaatgtgtcaggaagtctctatacaaagagtgaaaagagactttagcatgtgaaccaaatccaaataaattcttcctgaaccatacactagagggggaagaagaaccaacccataatcagacacaccgatctgccttgccagtagaagccactttgaaggtaatttcacagtccaccagactagttttgcatagaacaaacccacagtaagtcggcaagcagagctttcctatccttgttggacccactagaaactgtcccagctctcttaagcccgcttcctgcagcagcatccgtagaatttttgtactacacccaataccagactgggaaggcctatcctttcagtgaccctgctaactgctaggatgaatgtatagtaacatgtacaggctacattgtaaacagcacaaaacagaagctgacatgtgtggttattctttttaagagaattataaatactgtaatatataattttattttattggcatgcctttttgtaaatacaaattattaacttattaaataggaaatggcttctggcttatgccattgtcatgtttatttttattttttatacttttctttcttcttagaacttagatgctgtcagccaatgtacatccccaaaccagacagacagacaaaaaattttttattgctaatggtcttttccaaaacaacaaaaaatatatatttttgttccaatgtgcaataaattctaaccacgtctatgcaagatttggctaaacttaataattgttcttaggtcttgagatgggcaacagagctgtaagatcccgccaagtacaccatgtgctcatgctagtgatgtcattaagctactagggcatagtgatgagatttttctgagatctaaccgtttccctccgctagctcctgaccccagcccagcaggctgtctcctcagtaacacatgggccttggtatctggcacccatcagccagcctcataggaaagaagccacctccgctgtatttgaagtttcactttttaaaaaaaaaatgtttcccacctttttatccttcacccactgtccttccacctgctcactcactcactctctcacccatcctgctccacacttctttggtagtaaatgacaccatcaccagcagtttacacccgcagttaacaggcatcgaactgaaagaatcagtgatgacgtttttgtgcatcttcgctgagtgggtaagtggcaacgctttgccaaatattaacgaagccaatcaaagagcagcgcagccacagtatcactgcacatatatatatagatatataaatataatataaatatttattttttgtagccaggtccttggtgcagtatttatactccac

SEQ ID NO: 6300 - DNA, 327 bp, Homo sapiens
aaactggacctctatttctcacgatatacaaaaattaactcaagatggattaaagacttaaattttaaaacctgagactataaaagtcctaagaaaaactcttctggcctaggcaaagtatttatgactaagacccccaaagaaaattcaacaaaaaacaataacagacaaatgggacataattaaattttcaaaagttctgcacagctaaagaagtaacaggataaatggacaatctagagaatgggagaaaatatttgcaaattatgcttcaacaaagggttaatagccagaatctacaacaaactcaaacatttcaacaagaaa

SEQ ID NO: 6301 - DNA, 960 bp, Homo sapiens
tggctcctgtgcactttggttgctgagagtggttgtgggcagcaggccggtgagcagtgggggcagggatcttgacaccagcccttgttggactccacacccttctgaccattcatccacctttgggagtggggagcagggtctgttgaaagaggcagccgtgtcatgctcctgttagtaagggaactagacttttttgagcctaaaaccatacaagagaattcaacagaaagagaatttaatgtatatattcattcttgtaaaacaataatattgtagtaaaacttacatctgtgtgtttgctggccaggctagtcatttatgactttcttcgagtaagcgaaaatccttggagtctggcaattcttccttgtagggaatcttcaagaagactttagctccaactttattcttttgtatttcattacctctgggaaaattactagctgggcattttgtggcgattctcaacctcaactctagggctagtgcttttaaaatctggtcaactgcgtaattgtgaaacagtactgtgtcagctttatgcacttattattatttttttaagacacaaaaacttacaaattggcaaattgtttttcagtgttttccccttcacagggctttaaaaatatcttgagtatgttggggttagattgggtggttggaaagcaaagctccaagtgctagaatggacggctgccctctgcagcttcaacacagggatccactcagcccccttagctgactactggtgcttaaaacggtttttgacaaacgccagagtttcacaaatatagaagtagcagttatagaggtggttttgcaagtcccttggaacattcatgcaggtctgcagtcactcttaatttgaatgagaaagaagatggtagaaactatttttattttctcctgggagcaagagaaaaggaaggctagaactctgtactatgtaatttt

SEQ ID NO: 6302 - DNA, 782 bp, Homo sapiens
gcggccgctactactactaaattcgcggccgcgtcgacctgggagtacaagtgcacatcaccacacccaggtactctggagtctgaggtgggaggattgcttgagcccaggaggtcaaggctgtagtgtgctatgatcacacttgtacatagctacttcactccagcctggaaaacacagacagaccctgtctctaaaataagtcaacaaacaaataaagagggaggagggtaggaaggagagctgttataaaggacgcttatatgtagtcccaactacttaggaggctgaggcaggattgtgtaagttcaggagttcaaggccagcctgcgccatatagcaagcccctatctcatagctagctagctagatagacagatatataaataggatggatggatggatggatggacggacggacagacagatagatagataaagtaaataaacaaaatagaaaataggctgcccaatgttcacatcctgataagccacaggtcaaacactcctaggttcagactgaagttctcttcagagtctcctctgtaactaacactgtggaaagcatcgcgaggaaaggacaggaagacaaatccatgcccaggtcagcttgcaaaaagctaacaatcttgctggagaaacaagactgtttttgttttttgttttttgttttttaagacgcagtctccctctgttgccgaggctagagtgtaatggcacgatcttggctcactgcagcctctgccttctggattcaagtaattcttctgcctcagcctcct

SEQ ID NO: 6303 - DNA, 4064 bp, Homo sapiens
gtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaatgcatatac

SEQ ID NO: 6304 - DNA, 665 bp, Homo sapiens
gtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagataagaaattaaaccaattttaacatgattctccgaaaaaccaatacttgcactccttcctccatgaaaatgtgctttatccctacgcatttttccagaagtccagctttctacttatacgtttatattttcataaactttgctacagagcaaattcggtgttacaaacattgcttccttttgttcacattttacacgtttactgcctccttaaatcattcaccttcactgtattttaggaaagaaatgctatttatatattttgtgaatccacagtctattatacattctgctaactaagaataaaacttgtctacttggttatttgagtctagagaatgattttcaacctggagtgactttgctcaccaagggacatctggcaatgtctggtcacatttttggatgt

SEQ ID NO: 6305 - DNA, 3983 bp, Homo sapiens
gtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaatgcatatac

SEQ ID NO: 6306 - DNA, 3952 bp, Homo sapiens
agctgagaactcagtggcctttgtctgtggtgaatgtatccggaaaggcaaagaagagagagattctcctgtggggtttctcatctccatggcggtaggtgctgacagcttcagaagggtataacagggccaagagaaaagggccctgagatgctcagctacggtgctcttacaagatgaaaaggacatggggttcagatctgcacttcatcatctttcactaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaatgcatatac

SEQ ID NO: 6307 - DNA, 1346 bp, Homo sapiens
ctgtaagtagtatatgtgagtgccggcagttaggacagggagagataggagcaagtaggactgctgtgattaggacggatcagacgaagagggtgtgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaatgcatatac

SEQ ID NO: 6308 - DNA, 570 bp, Homo sapiens
ttttgtgatatggaaagatttttattattatataagcttccagaggtttgatcagaaaacaaagatgtaaataggcatggaagaaggctattcttggttcttgttttctgtccgccaccattggcaagactatctactatgcgtaggcatgggaaccagttaaagaaagtgtcgattcactagagcgaagctgagaactcagtggcctttgtctgtggtgaatgtatccggaaaggcaaagaagagagagattctcctgtggggtttctcatctccatggcggtaggtgctgacagcttcagaagggtataacagggccaagagaaaagggccctgagatgctcagctacggtgctcttacaagatgaaaaggacatggggttcagatctgcacttcatcatctttcactaaggtaagatcgtgttgtggattaaaagtgttccaagcttgaactaattgcttgtcggctcttttaagctcatcctttttgcatgtatccccgctaatatgcatctttatgatgctttttttggctcagcagtcatgctttatggaggcatgctctatgg

SEQ ID NO: 6309 - DNA, 362 bp, Homo sapiens
gttaaaattggctacaatacttttatttttgtttgttttgcacaggagtaactcaagatgattttgatgttgcagttttaaatttcactttgacttgagctgggaaatcctttggcctattataccatggatgctaaaaatggtaagagctgcatgttctgccttgatgttttcaagactgaatttggagggagaaaaattattttgcctaaggatgtccgtgaaagtatcaggaaaacactgaaaagccggagagaagggttcaattgtagcgtgctccctttaagagggaaacgagattagcaactttggcaaatttttgggactctattcagagggaaagagaagagctgccagtgtca

SEQ ID NO: 6310 - DNA, 2112 bp, Homo sapiens
gtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaat

SEQ ID NO: 6311 - DNA, 4033 bp, Homo sapiens
agctgagaactcagtggcctttgtctgtggtgaatgtatccggaaaggcaaagaagagagagattctcctgtggggtttctcatctccatggcggtaggtgctgacagcttcagaagggtataacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaatgcatatac

SEQ ID NO: 6312 - DNA, 2031 bp, Homo sapiens
gtaggaacaaaccggtgtcaatggttaacccaggttcttggtgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaat

SEQ ID NO: 6313 - DNA, 1689 bp, Homo sapiens
tcagagacgcagagagaggccaaggtgagatgaggctggggtgaggtcttttaggaaagtgtgtgtgaaggaagaggggtaggagcaggagtaggcagggagagccttcagtcttggtagaggtgcacctgtgacgaggttggggaaggaggagggctgggtttcagtgcaggtctgagaaatggagtgggcctgaactagccccagagcattagttccgtgctctgccattccctggaaaaagcctcatgccacacactggtggacccagaggcagcagcacagcttccaagcggcaggcactcggccaccacgggactgctgagaagtatccttcccagtgtgctgcatctcagcaagtcagaaagcacagccagctttccttcccacaggcttcttccccacacacgggttacttagagcgttagtcctcggacagtctcctcactccactttttcattgtattctattgttcatattgccatggtatcttaaaaccatggtttgcggatggcgctctcctgccaggaactcttcctctgtcatgtgtgggattaatttaaactgttgagcatgacatcatcttccagccttacttcttcaccttgaaatacgcacactatagatgtcattcatattgaactgtatattattaatatctgtgctgttaccgttgtcggtactctactcctgctcctgctgttgaacttacacacttacttattttcttaattctaatcaggcgtccttttatgtggaaaacctcagtgtcttcctacttaacatgtcttccccaggagtgattcttagttacttgcttctatttttgcactggtcacattgtgtttcaaacgcgtgccgctgtctgtcctccacgcttagtgagggtggtccctgagatcctgggcttgaccagctgcactttctctgatcctcagcacctcacatgggcctgctgtatgttcagtgctcagtaactgttgtttttataattaataccttgcaaataagcatgtaaggtgactactagcattttgcaaatgcgtatagtttataggttagaagcaactgccagttttgtcacatgtgccatagggcggatcctcaccaagttggaaatagtgagctcttgacttgatgatggagtattctttgtgacttccccataagctctcttaaatgattaatgttaggacatacgtgatatttccgtggccgaggcatcaccacattacttcatgtgtgttagatgatcattgtacacgtagcttagtacacagatgcctttagaagacttacaaagaatcgagtgttttctttcatgacatcagtgtttttaatgcttcacactcaattctttacaagctgattaaagaattactttgtgccgtcaatatatattcctttgtttccttcatacaatacagttctgtgagaaaagactgtacgaccagcctggactcattccttgtctgagatgcattccgtaagctaataaagccaaacctctatttgtaatatggtccagagcttgttatggaaatgcggcccttgaaaaaaataaaataatttataattgttcagatttcaaaatcatgataaattagtgattccctgaaacatgagaaagagaagcaagttgtaggttatattttcatgaatctgaattgaaatagtgatttaaaaaa

SEQ ID NO: 6314 - DNA, 1409 bp, Homo sapiens
  misc_feature (1399)..(1399): n is a, c, g, or t
  misc_feature (1401)..(1401): n is a, c, g, or t
tcagagacgcagagagaggccaaggtgagatgaggctggggtgaggtcttttaggaaagtgtgtgtgaaggaagaggggtaggagcaggagtaggcagggagagccttcagtcttggtagaggtgcacctgtgacgaggttggggaaggaggagggctgggtttcagtgcaggtctgagaaatggagtgggcctgaactagccccagagcattagttccgtgctctgccattccctggaaaaagcctcatgccacacactggtggacccagaggcagcagcacagcttccaagcggcaggcactcggccaccacgggactgctgagaagtatccttcccagtgtgctgcatctcagcaagtcagaaagcacagccagctttccttcccacaggcttcttccccacacacgggttacttagagcgttagtcctcggacagtctcctcactccactttttcattgtattctattgttcatattgccatggtatcttaaaaccatggtttgcggatggcgctctcctgccaggaactcttcctctgtcatgtgtgggattaatttaaactgttgagcatgacatcatcttccagccttacttcttcaccttgaaatacgcacactatagatgtcattcatattgaactgtatattattaatatctgtgctgttaccgttgtcggtactctactcctgctcctgctgttgaacttacacacttacttattttcttaattctaatcaggcgtccttttatgtggaaaacctcagtgtcttcctacttaacatgtcttccccaggagtgattcttagttacttgcttctatttttgcactggtcacattgtgtttcaaacgcgtgccgctgtctgtcctccacgcttagtgagggtggtccctgagatcctgggcttgaccagctgcactttctctgatcctcagcacctcacatgggcctgctgtatgttcagtgctcagtaactgttgtttttataattaataccttgcaaataagcatgtaaggtgactactagcattttgcaaatgcgtatagtttataggttagaagcaactgccagttttgtcacatgtgccatagggcggatcctcaccaagttggaaatagtgagctcttgacttgatgatggagtattctttgtgacttccccataagctctcttaaatgattaatgttaggacatacgtgatatttccgtggccgaggcatcaccacattacttcatgtgtgttagatgatcattgtacacgtagcttagtacacagatgcctttagaagacttacaaagaatcgagtgttttctttcatgacatcagtgtttttaatgcttcacaaagtaattctttaatcagcttgtaaagagtcgaccggccgcagaatttngnagtagtag

SEQ ID NO: 6315 - DNA, 362 bp, Homo sapiens
atggactaacccgctgagcagaaaaatccccagtacaacaaaataaccctaaggaatatatatattttttctatagtggctaattggagaggagtaagagttcagactctgtaagtaaatatctgatttcaaattccatcctatatattttcccaatacttcatttatacttgccaaattttttctcttccccaaaactacctttgggaagggattaggaatgagtccctaatttaagtcttgcattgtttaagctttaaatcagggccgaatattctcttaactatgaatggtcattgaacaaggaaaaacaacagatacacaaacgtatatgtatcttggaatgggaaggaataatgagg

SEQ ID NO: 6316 - DNA, 342 bp, Homo sapiens
tatttgtttgtaaattgcctatacatatccccgttctttttttctatcagataggctgtcttttttatattgatttttatgtttttatactttatgaatattaaccattcttatgttttaggtgttgcaaattttttcttttttatcatttgtcttttgaatgtgtttatagtgacttttgctggtgtaccaaagcttccatttttaaaatacaaaatacatgaatctttgtgaatcctgggtttcgtcctttattgataaatccttctttagcataagattataaaaacattatgctattaatttaatcattatggttttttatatccgtaatctatctca

SEQ ID NO: 6317 - DNA, 328 bp, Homo sapiens
ccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcct

SEQ ID NO: 6318 - DNA, 1057 bp, Homo sapiens
ggttgatctcaaactcctggccccaagcaatccacctgcctcagcctcccaaagtgctaggattataggaataagccaccatgcccagcctaaaagcatgttttgaactcttctttttttatgattcatatttaattatttttagcagaaagagaaatgttaaatttctgtatgaaaatttttataaccactttctatgttatgtatgtatatatacatatatatttttgtaattatgtttgtaccagcctggacaacatagtgagaccatctctacagaaaattagaaaaattggccaggtatggtgttgtgcatatgtactcccagctactcgggaggcagaggcaggaggattgcttcaccccaggcatcaaggctgcagtgagctatgatggtgccattgcactctagcctggatgacagagtgagaccctatcttagggtcagggttaaaaaagaaaagtttgttcagttatcaaatagtgacgaatttgtattcagaagtacactaatacaagtttaaatttttcagaaaaatcaatccccagtgataacatagtcatgtgatacttttttttccattcaaagatcacaacatatttctttaaagaacaccactactctacctgggcaacaaaacgagaccctgtctcaaaaaaaaaaaaaaagaaatcagaacattgtaggtataaaacatccatgagcctttacctcagaaaggtaaagttagatatgaagaaagttaaggaaaacatagtaaatgggaagaatcttagtatctctaagaggagatactttctggtagttagtgactccctgatgactggtatagacccataactgagcacctgataatatatcccataccactgattttttttctgccccttacgctacttttgagaagaaaaagaaagatatgaaagcccagcatggtggctgacacctgtaatcccaacattatgggaggccaaggcgcgatcctcgcttgaggcctgaagtttgaaaccagtctgggcaacactgagatctcatctctacccaacaaaaaaaaaa

SEQ ID NO: 6319 - DNA, 476 bp, Homo sapiens
tgagtgacataaagtaacacatccaagcagttaaaagatagaacaggattagaaacagcaaattataatgagcagggcgatcaactctgaaagagggaaatgaaataaaaattcaagaatagagcatagtgaaaacaagtacttttgggtagtcaagtgggtaaatgtgacactctaaaggagaaagtaaaacaggtcaggcacagtggcccacacctgtaatcccagcactttgggaggccaaggtgggaggatcgctttagttcaggagtttaagaccagcatggtcaacatggcaaaacccatgtctctaccaaaaagaaacaaaaaaaattgctggggcatgtacctgtggtctcagctacttggaaggctgaggtgggaggattgcttgagccgggaaggtagagtttgcagtgcgctgagaccatgctactatgctccagcctgggcaacaaaacgagaccctgtctcaa

SEQ ID NO: 6320 - DNA, 771 bp, Homo sapiens
gaaggagaagaatcaagtgcagggttgggactagtgcttctcaaattttaatgtgcaggagaatcatgcatggatcttgttaatgctgattctggtacagtaggtctagggcggggcctgagattctgcatttctaacaagaacccaggtgatgctgacgctgctgggccaaaaaagacactttgagtagcaagggttaggcaacctttaaagggcccttcaagagtctaagattccatgaaggatactatttcctctacaagcttgtgaaagtcttccagtgctactgggaatggggtacagggataaatctcactgttttgacctcacagaagtaaacccctagaatcatgttctcaaaatgaaacactggattgctgaactgatggcattgagaattaaggctccaaaatcctgggagtttcatacctaactccactgcctttgccttatgatgcacactgctccctctatccctccctcccagggtctgcagagatgaactatgctgttttaggtctcattggtccttataccttccctaaaccaggaggactttggagcctgctgacacagggagttctacatgtctaagcacgcagctgctagagtcctcagccatctgagctaaatagctgctcagagacaattagtacacctccgtatcttacagataaaggaactgaagtccaaacaagccaagctacccaaccaaggctcacagcaggcaagaggataaaaaccatgtcctttgactcccaggttagtttt

SEQ ID NO: 6321 - DNA, 6174 bp, Homo sapiens
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagaggggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcctgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccggctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccgtgagggagccccagaatggggtgcatttggtgctgaggctttgaagccaccgtatttttcgttacctgtgactatggagccaatgggatgtgacttcgctcatcacggtcagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcccggccccccaccgccaggccatagggcataatttgcatctcaaatctgagaataaactgatgaactgtg

SEQ ID NO: 6322 - DNA, 6617 bp, Homo sapiens
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagaggggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcctgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccggctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccgtgagggagccccagaatggggtgcatttggtgctgaggctttgaagccaccgtatttttcgttacctgtgactatggagccaatgggatgtgacttcgctcatcacggtcagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcccggccccccaccgccaggccatagggcataatttgcatctcaaatctgagaataaactgatgaactgtgaaaaaaaaaaaaaaataaataatataaaaaagggggggggcgcggcactaaaaatggtttccttgggggggccgagtgttataccgtgttaccacgaggttttctttggttccaagtggggccctaaatagggggcgccgcattctaataagctaagagcaagtgggaccagtaggatattaaacaaaacgatgtggggattggggggcaaaaacgtgggtcagactgggggagatcttgtgtggaagcggaacccttaaacattcggggggggtgtggaccacatatttgggcacaactcttcactctcggaacatttacacgctcaagggagtaaaattattaacttgcaaaggcattaggctggtaaccacgatggaatatgactgctcgatgaaagagtatgtacaggggagtatgatgtatgaaacttttttcaggac

SEQ ID NO: 6323 - DNA, 5493 bp, Homo sapiens
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagaggggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcctgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccgggtaagagggtggggcagtggccagctagagaggggaggcaagatgtcggccaccttcccggtaactcaccgtctctgtcttctctggggacagctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccgtgagtgcaccccaacttgcgcgaaagagcaagatcccaaccacttacccccc

SEQ ID NO: 6324 - DNA, 4562 bp, Homo sapiens
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagaggggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcctgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggtgagtacaccctgcttccgtgggcttacacatcccagctccccacccccttcactgcaccagaaccctcca

SEQ ID NO: 6325 - DNA, 694 bp, Homo sapiens
ggccctgctggcctcccaggaatccccggcattgatgggatccgaggcccaccgggcactgtgatcatgatgccggtaagaaggagatggagtggcccagccttggggagtggagtcctgatccaggagggggcctctcctgggggcttccctcaccactaaattcctcccagttccagtttgcaggcggctcctttaaaggccccccagtctcattccagcaggcccaggctcaggcagttctgcagcagactcaggtgagtgggaggtgtggacatagtgggaggaaccccagagagtgatagagcctcggcgtaaggaggggctgggcaggagaagggggttatttttctcctgaagatgcctctgtggggaatgttgggggtcttgtgggaggccccaagctctgactcctctgtctttccagctctctatgaaaggcccccctggtccagtggggctcactgggcgcccaggccctgtggtgagtaaggcgactgcgtggagggggcggtgcatgcattagtgaagaatcatctacccacactcctccatctctcctcccccaagggtctccccgggcatccaggtctgaaaggagaggagggagcagaagggccacaggtgagacttgtggagatagggcaggataggatgggaatagccttcccccaggaccacaagatacagtgct

SEQ ID NO: 6326 - DNA, 1533 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttgaagctgtgttcaggttgaatatctctaatctgaaatttgaaatgctccagaatctgaaactttttcttttctttctttctttttttttaattaaagttctagggtgcatgtgcacaatgtgcaggtttgttacatcagtatacatgtgccatgttggtttgctgcacccattaactcgtcatttacattaggtatttctcctaatgctatccctcccccagccccc

SEQ ID NO: 6327 - DNA, 682 bp, Homo sapiens
acactgtcctcgccacaggactgcaggctggtcgccagattcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccgaggaagcctctccttcagaggaagcctctccagtcacctctgccctctccaatgacatgagtcctcccagg

SEQ ID NO: 6328 - DNA, 1333 bp, Homo sapiens
  misc_feature (790)..(790): n is a, c, g, or t
tgaccctcagatataattctaatatcaccagttggcctttcttgacatctcttttagtcttctctctttttcagaaatgtgagttctttgcgaaatgttttgaactgaattttaggtcattaaattgtgagttttggaatatagtggaagggacatgtgagtgttttagattagtagaatgacaatcatttcaatttctttaagtattttcatcttctgtttttaggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaancaggccaaactaaaaattctaatggacaagccagagatgaatgtggtttcgaaaaatgtcaaacacagaccaatgggtgaaagttaaacttaggaacagatgggtcttatccggacccagtacagatctgccatgctggaaagttattaccaggcattcgtgaacctttctctgaccactgtggatcgacttggattaccagaaatgacctcttctccttgggctcgaggctggcatcatcaagcacttgtagaggtctaacagtcatggaggctctgggaatgagcccaattatacggtatggagcgaactgaactgtaacctggggatacacatcaaacacgtgggcccacgacagaagttctatgaggaaaaccaacgagtttgggaaaacagaccatcagcctatcaggggaaaaccgcggagcgaccccaacactgaaaaggccccgcgaacacccaccgtaagagctgagaccagcacaacagcaagcagcgcaaggcacctagcaaaagccgcagcgtaagacacgcgagaacaac

SEQ ID NO: 6329 - DNA, 659 bp, Homo sapiens
acactgtcctcgccacaggactgcaggctggtcgccagattcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcatggtggaactactccacattctctacacgtaggcatatgaccgagtataaccccgacggataacctcatggctttcatgagaggacagccttat

SEQ ID NO: 6330 - DNA, 456 bp, Homo sapiens
gcgaggtgatctagaggatccggtatacataaccccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaaccaagttatgttataccgggtaccga

SEQ ID NO: 6331 - DNA, 805 bp, Homo sapiens
tgtggcccgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccattgggcagcctgaccgccccccacgccaggggccccagtaaccccggccaggctgtccctacactccttcttctcccaggtcctgccgctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctg

SEQ ID NO: 6332 - DNA, 3145 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6333 - DNA, 3168 bp, Homo sapiens
cattattgatttgaaggcatttgcattaaatttgaaatgttaaaatgtaaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggttgctgctaaaaccttgcctttttataaggactacttcaatgttccttatcctctacctaaaattgatctcattgctattgcagactttgcagctggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6334 - DNA, 3116 bp, Homo sapiens
cattattgatttgaaggcatttgcattaaatttgaaatgttaaaatgtaaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggtaaatgtacttgaagaggattgttccagcagtccataactccaggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6335 - DNA, 3159 bp, Homo sapiens
gtggaggccgccgcccaggtgaggcaggcgactaatcagattgtgatgaatgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaagtatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggttgctgctaaaaccttgcctttttataaggactacttcaatgttccttatcctctacctaaaattgatctcattgctattgcagactttgcagctggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6336 - DNA, 3103 bp, Homo sapiens
gtggaggccgccgcccaggtgaggcaggcgactaatcagattgtgatgaatgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggttgctgctaaaaccttgcctttttataaggactacttcaatgttccttatcctctacctaaaattgatctcattgctattgcagactttgcagctggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6337 - DNA, 2995 bp, Homo sapiens
cattattgatttgaaggcatttgcattaaatttgaaatgttaaaatgtaaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggtaaatgtacttgaagaggattgttccagcagtccataactccaggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacactcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6338 - DNA, 2652 bp, Homo sapiens
atgtcaaggaaaattctggacatattttattgtcagggtctgttttgtgaatactttaattctcttgacttagcctatccctacttcagtttatatatataattttgtatctaaagaactagagttataatcctacttcaacatatttaattaggctcccatataattgtaattcattacaattagtgcaagaaatctaatgttcttcacctccatgtcttcctcatcactcctctgcaactaccccaaaaataaacagaaccatagtggcttctttcccagcagaacaaagccaggactggaacccaagctctaagggatgacaggaatcatgttctattcaactttattattattagttactacatttttttgaggaccatcgttatacattatgagtgagttaaaggcagaaaaatgtaagttagaagggttttcctagaaagcgttttatgtaattcagtattacgggctatctgcttcctgtcataaccctgaatcacattgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6339 - DNA, 2355 bp, Homo sapiens
tgtggcccgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccattgggcagcctgaccgccccccacgccaggggccccagtaaccccggccaggctgtccctacactccttcttctcccaggtcctgccgctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6340 - DNA, 2029 bp, Homo sapiens
aaaggttttctccctgagaggcatgacccaggccagctgattcatcagaatcagaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6341 - DNA, 2037 bp, Homo sapiens
acactgtcctcgccacaggactgcaggctggtcgccagattcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6342 - DNA, 1853 bp, Homo sapiens
ctcggtacccgctgatccgcttaagttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6343 - DNA, 2528 bp, Homo sapiens
tgaccctcagatataattctaatatcaccagttggcctttcttgacatctcttttagtcttctctctttttcagaaatgtgagttctttgcgaaatgttttgaactgaattttaggtcattaaattgtgagttttggaatatagtggaagggacatgtgagtgttttagattagtagaatgacaatcatttcaatttctttaagtattttcatcttctgtttttaggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6344 - DNA, 1995 bp, Homo sapiens
cgtcgattcttgccggttttgacttggaagacccttgccctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6345 - DNA, 3091 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6346 - DNA, 3079 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6347 - DNA, 597 bp, Homo sapiens
aaagcatgatcgagctcggtaccccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6348 - DNA, 3098 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaacaccagaccccagatcacaaagccaaccatgcccagcccctcccagcacccccagccccacgaccatcgttttgaattctgacgacaccgtgagcctgcctttgtacttcaaactcatggaaggataaccaccttcatgttttgaaataaatgtttcctgttgaaatgaaaaaaaa

SEQ ID NO: 6349 - DNA, 2912 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgtagatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaaccaagcaaccactggtaccgagctcgagta

SEQ ID NO: 6350 - DNA, 1556 bp, Homo sapiens
cattattgatttgaaggcatttgcattaaatttgaaatgttaaaatgtaaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggttgctgctaaaaccttgcctttttataaggactacttcaatgttccttatcctctacctaaaattgatctcattgctattgcagactttgcagctggtgccatggagaactgggaccttgttacttatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttgaagctgtgttcaggttgaatatctctaatctgaaatttgaaatgctccagaatctgaaactttttcttttctttctttctttttttttaattaaagttctagggtgcatgtgcacaatgtgcaggtttgttacatcagtatacatgtgccatgttggtttgctgcacccattaactcgtcatttacattaggtatttctcctaatgctatccctcccccagccccc

SEQ ID NO: 6351 - DNA, 1859 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggtaagtgaacagctgcccc

SEQ ID NO: 6352 - DNA, 1950 bp, Homo sapiens
  misc_feature (1407)..(1407): n is a, c, g, or t
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaancaggccaaactaaaaattctaatggacaagccagagatgaatgtggtttcgaaaaatgtcaaacacagaccaatgggtgaaagttaaacttaggaacagatgggtcttatccggacccagtacagatctgccatgctggaaagttattaccaggcattcgtgaacctttctctgaccactgtggatcgacttggattaccagaaatgacctcttctccttgggctcgaggctggcatcatcaagcacttgtagaggtctaacagtcatggaggctctgggaatgagcccaattatacggtatggagcgaactgaactgtaacctggggatacacatcaaacacgtgggcccacgacagaagttctatgaggaaaaccaacgagtttgggaaaacagaccatcagcctatcaggggaaaaccgcggagcgaccccaacactgaaaaggccccgcgaacacccaccgtaagagctgagaccagcacaacagcaagcagcgcaaggcacctagcaaaagccgcagcgtaagacacgcgagaacaac

SEQ ID NO: 6353 - DNA, 1690 bp, Homo sapiens
cacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttgaataacttttaaaagcagagtctgtctgtaaacaagtttttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtaagcctacgggagccaca

SEQ ID NO: 6354 - DNA, 885 bp, Homo sapiens
cattattgatttgaaggcatttgcattaaatttgaaatgttaaaatgtaaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttacatctacatatctggtggcatttgttgtgggtgaatatgactttgtagaaacaaggtcaaaagatggtgtgtgtgtctgtgtttacactcctgttggcaaagcagaacaaggaaaatttgcattagaggtaaatgtacttgaagaggattgttccagcagtccataactccaggttggggaatttacatttctggtcaattattagtacagttatttataatttaatctgaaagttgtgctacttggtttatttttaatagaatttaggaaatgccaaccttggtgtttcgttattttacaaaataataattaagagaatataagagtggaatttctctagggaatgggttggaaaatatgtagttatatttttcatatcaagttataaatgg

SEQ ID NO: 6355 - DNA, 464 bp, Homo sapiens
atatatagatatatatctcaataaatgtttatatttattttgtgaaggtgccatggagaactgggaccttgttacttataggtatgttaatgatgtattaccctgccttatcttttcaaatcactgatttcaaaagggcttccctcctaatcacagttgagtagcttctgctttacgatatggtgtaaatttttctaccttcccccacttccatgcacatttcaagaatgcagatggacacctctccctttggtgctactgtctgagggtgtaagattttaaagtgagcatctggcggtagtagcatttttagatatattcttggctaagtttctcattgcagtgcctttctttcctgccagtagtttcacagctatttatccagcttggagaaccttccctaatttcatatcttctagccaagtttttacatgtctgtcaccacaacataaacatgtgagttg

SEQ ID NO: 6356 - DNA, 172 bp, Homo sapiens
atagtttgttctaattattgaaatatctttattttatttttaaagatagtgccaagttttaaggggggaaaaccctagaccttaaattgactgagttgagttgtgtgtaaaacacttcccttcctttatacttcataaagttttggaataaattttatgcatatactgccag

SEQ ID NO: 6357 - DNA, 350 bp, Homo sapiens
tcagaagccgtgtctgatttattttgtatcctgtacaaaatctacaatgccttctctaattctatatgtcagagcaaagtaatatgttttctcttttgtattagaccatccctcagattctatttcttcctcacaattactgtattgccataattattcattctcatatctgctgcctatgctcaattctgagtccctgaagggcagggagcatgttctagtcatctttgtactcctgtatctgtaagagggttgggcatatgatgagtgcctgttaacttatttatccacccaacacaatacctgaaatatggtcaatgcgaaataaaaagttgatgaagtgtttgttg

SEQ ID NO: 6358 - DNA, 618 bp, Homo sapiens
taattgtgttttaaatactttgaggaatcaccaaactgccttctgcaatggctgaactaatttacattcccaccagcagtgtataagcattctcttttctttgcaacctcaccaacatctgttattttttgacttttttataatagccattctgactggtgtgagatagtattgcattgtggttttaatttgtgcttccctaatgattagtgatattgtgcattatttcatatgcttgttggccatgtgtttgtcttctgagaagtgtctgttcatgtcatttgcccatttttagaggagttctttctttctttttttcttgattttgtaaagttacttatagattctggatattaggtttctgttggatgtatagtctgcaagtgtattttcccactctctaggtggtctgtttactgtgttggtagtttctttcactatgtcaaagctccttagtttaatttggtcctgtttgtcaatttttatttttgttgaaattatttttggagtcttcaccatgaaatctttgccagaccaatatccagaatagtatttcctaggtttttctctagggttttatagttttaggttttacatttaagtctttaatccatgttg

SEQ ID NO: 6359 - DNA, 347 bp, Homo sapiens
ggtcgacgtaaagagcaactcaacatggattgaagacttaaatgtgaaacctaaaactataaaaccttatagattctggatattaggtttctgttggatgtatagtctgcaagtgtattttcccactctctaggtggtctgtttactgtgttggtagtttctttcactatgtcaaagctccttagtttaatttggtcctgtttgtcaatttttatttttgttgaaattatttttggagtcttcaccatgaaatctttgccagaccaatatccagaatagtatttcctaggtttttctctagggttttatagttttaggttttacatttaagtctttaatccatgttg

SEQ ID NO: 6360 - DNA, 539 bp, Homo sapiens
gttgaggtttccaatccatgaacatggaatatctttcctttttttgttgttgttgttgttgtcctcttcagtttgtttcatcaatctttgatagttttaattgtagacatcttttacttctttaagttaattcataagtatttaattttatttgtggctattgtaaatgggattactttttttattctatttgagattcctcactgttggcatatagaaatgctactgatttttgactgggccacggtggctcatgcctgtaatcccaatactttgggatgccgaggcaggcggatcacgaggtcaggagatcaagaccatcctggctaacatggtgaaaccccatctctactaaaaatacaaaaaaattaaccaggcatggtggcgggcacctgtagtcccagctactcaggaggctgaggcaggagaatggcgtgaacccgggaggcggagcttgcagtgagccgagatcgtaccactgcactctagcctgggtgacagagcgagactccatctcagaaaaaaaagaaaaaagatgc

SEQ ID NO: 6361 - DNA, 461 bp, Homo sapiens
ggccagtgtcacgggctgtaaaggaatttaccaagacagtcataggtaaaggcagatttattggagaaagtgtgaaaatatgttgcaaggttgcagtgagcagcacagcagagaaggggaagtctgcaaagacgcagcggcttgagggacgttttacatggtcctgctggaggggactgcttgcagaatgtagccgtgctcctggggctacctgtaggaggtcatctctcagagtaattactcattgttctcccccacctgggccccttcctctttgttgcttacttaccttgtcaggacttacttatcttatcaggactacacactatgtgctaggccactttatctcagaaaatttattatttaaaaacaacactagtatcatcctgaaagctagaagaatttaagtgtagtctccttacaaataaaagcaaaatctacaagagcctactccaaaactt

SEQ ID NO: 6362 - DNA, 561 bp, Homo sapiens
taactcaataaaaggtatctactaaaaagctatataaaatctccaacaacagtaattcaacgtgctttttaatgttggaaacaacacaaggaaagctgctaccactgctactatttaaaattgcattatgggcaggtgcacgcctataatcccagcactttagggagtccaaggtggggaggatcactgggaggccaggagtttgagaccagcctggaaaatatcgtgagactcccatctctacaaaaattaataaaaaattagccgggcatggtggtacacgcttgggaggctgatatgcaaggatcacttgagccccaggagtttgaggctgaagtgagccatgatcatgccactgcactccatcgtgggtgacagagcaagacttagtctctcttaaaaaaaaaaaaaaaaagaaaagaaaaagaaaaaaagaaaggtcgaactaaaacagcaagttgtaaagatatattattttttatttatataatcaattcaaatatgccagtatatctgtttttagtatgcccactgtatatacactgtatatacaagcacata

SEQ ID NO: 6363 - DNA, 336 bp, Homo sapiens
gccctgaacaaaagcaaagaacaatggaactttaacttaggggcttcagtaaaactgtttatagttctccccacagcctgcagtaacagatgctccctctttgtgccctgcaatgcaaagtgaaagcttaaaagactaacacagtgataacagtgatgacgacaccaagagtcagtcagcgaggcccaagacaacacccccttataagatttgtctagaaatgttatttacacttctgccaatagcatacatgtcatactgtagaagataatagttaacaccaaacataaaatttataaaatagtttgtcctgctgcaaaagaaaaaaaaacccac

SEQ ID NO: 6364 - DNA, 564 bp, Homo sapiens
ctcattgataccagaactggagaggaaatcttcacaaacttgggttgtgttggttcatgagccgtcctggacccatagtcaccctcaggtcccagatttgttatagcctgggatagttgtcaggggttcctaggtgagttcattaatacaggaaatggacctgggatgccaagcagctgaaagagcctgaccaagtcactgttctccgtcctattgtcatagtctttgatgcagagctttgggatgaaactctgcttctgccactgatttagaaaccttgggcaagttatttaaaaccttctaatgtttccagttctattcccctgtaaaattaggctattagcatcaattttatatgtctattgcatatgcatcacaaatatgtttctgagactggcgacatgagatgcatacactgaattacatttttaaaaaatataaggcccagatagacacctaagtctgttattcaccttatacttgtaatttttacttaggcattttgcacagttttgaactatgtctaaaaaacaaccaaagtgtttggtagaccatactgtgtct

SEQ ID NO: 6365 - DNA, 339 bp, Homo sapiens
ctgcctaaaatatcactcccttttttctctttccatgctgaaaattctgtgccctctttcagctacacttttgatcactgagattatatgcttatgactttctggcattaaaagatttcactgactgctcagtttttctgagggtgtctatttagactagtacccctaaattttaagcgttcaataatgtaaaatttgtgagttataatgtttcatacatagtacaaatcacacctacattgcactgctttctaacttaaaaactgtacatttcaaaaagtagtaaatttgggagttattaagagggaataaaaacattgagttttaacgtagtgtgaa

SEQ ID NO: 6366 - DNA, 525 bp, Homo sapiens
gttctctcttcagctgtgtctattctggtgtttaatttgttcatgaaggctttaaaaaaaaagtctttattttctctattcttttctagaagtagtatttggttcttttctttctttatatcatatttttattacattttctgctatctcatttaattttagtcagatttaacatatttattgtatagacacttccagactttcatattatcatcaattattagagttattaaatattgtgtgtgtctgtgtgtgtgtgtgtgtgtgtgtgtgtgttgactcattgactcattgactctctgtcatggatttttagcctgacttggttcttcttcccctctaggtagccctataagtaaagccaccccttttgggtggtaataagaagaggaaaagccaaatatttgcaggcaatagacagttccgtttctaggttaactgtcccatgaagagcagcatttttgtaaaattcttttcttatatcacaattccttctggttaattacatgaatgaattgaacagaa

SEQ ID NO: 6367 - DNA, 407 bp, Homo sapiens
agaacaagctcagatgcttgatactcagatgcttgatgctcagagcttttatagctgatgactttctgaaaaatgatattaaggtttggagttcagtatcaataccagtaaagaagggaagaaacaggcaggtgcggtggctcacgcctctaattccagtactttgggaggccgaggcaggaggattgcttaagcccaggagtttgagaccagcatgggcaacgtagcgagttcttgtctctgcaaaaaataaataaaattagcagagcatggtggtgcgtgctggtagtcccagctacttgggaggctggggcaggaggatcgtgtgaacccaggagttggaggctgcagtgagcgatgatggccactgtactccagcctgggcagcagagagatgccctgtcttt

SEQ ID NO: 6368 - DNA, 423 bp, Homo sapiens
ggagcacttgtcctttggctggcagttgcctggcttatcatctgccaagaaaataaagaatatgttaggtaggcgtaaccatgacagcagccaagtcaacatttactcatttatggaactcacatccttttagcaaaaatagcccaagtaggctgggtgcgatggctcacacctgtagtatcagcactttgggaggccgaggcatgtggatcacttgaggtcaggaggtcgagacaagcctggccaacatggtgaaacactgtctctactaaaaatacaaaagttagggtagcagacgcctataatcccagctactcaggaggttgaggcaggagaatcacttgagcacgggaagtagaggttgcagtgagccgagatcacaccactgcactccagcctgggcaacggagaaagaatgtctca

SEQ ID NO: 6369 - DNA, 429 bp, Homo sapiens
tcctgccgagtggcctctgagaacctgcacagctgtgtgcttgggacccgaggccctggtggcgtgagctcacgaggggacctcctgatccatgggttgcacatatcagtgggaaaagtgtggtttcccggatggggtagcacaatcactcgccacttcccttggctgggggtgggaggtccccttgccttgggtggctcctgggtaggctgtcactccaccctgctttttctcgcccttcgtgggtcacgccaaccgcctagtcagtcccagtgagaacctggacacctcagatgctggcgcaggattcactcgctgtttttattctgcttggtgggagtctccaaccatagctgtttctagttggccatcttggccccagaaatgctctttttctagattttgggttatcagttggggccccatctt

SEQ ID NO: 6370 - DNA, 840 bp, Homo sapiens
gagctgggatctgaacccagggaatttgacttcagcctgtacttgtaactactgttctctatgggtagaagtcaaaaaatggaaaggaggcaaatgatagaaaaaatgttgcagagatttaatctctagtatttctaagtgggtacatgggaaatggtttgaatgaaaagggaatgtgtaagagggtgaggtcgcctgaggttttaagaaggatgaggttacctgagattttgagatttggtgactgacaggctgaattgagatgccattgacagagaagaaagtatagtaacactgaagccctggaaggagaaaatttcaaggagaatggtctgattcaacagtgtcaaatcctatgtgtttaagctatgcctttcttttaagagtttatgctttgctaggggaggtatgataaatgtataaccacagtagagttcagaaataagctaagagtcatataattggaaatatgacattcagagggagactggtggcgttaggatgcggtggggtggcaggggagaggccatttccagcctcatcagtggtctgtgaaggaagacctctctagtggaggtggtatttaagctataggctgaattgaaagtaggcatggtagatggaggaaatggtttgtgtgtagacatggagttgtgaaacccaggtagtgctaatgaaacaacatagaccagattgatgggatgaggtttatgtaatgaagcagtgagagagccagcttgaaagacaaacggacagaattatgtgaagggtgaggtgaaggaatttggtatttatttagtagttaaattatcctaagcacattggattaaaaaaaaaaga

SEQ ID NO: 6371 - DNA, 614 bp, Homo sapiens
attcatggagacctcttaagagtcaacagcaaaattccaagcacagatcatggtggattagaacaagaagttagtagtggaggtagtaaaaatggaagcccaaaggttattctcattccagcttctaattagtgtcagttcctctcagattctggcattagataattgtcttgattttgtgcgtttttcttaattttcggttttcatgattgttagataccattctgaattagatattgtcctgaatattcaactgtacctaattatgatcctgtacttaatatgcttaaaacatggcagatgcttggtaaattcttacaatgaatgtgtatcttaaagggtttgggtagaatgaagtagatttatcttcacaagcctattttcaggaccacatttctattgttattgcttttctctctatgattagcatatatacccatactttagctacttgtgttctttaggcttatttaggagatggatggtggatttgtatagtttaattttaaccttaatactcagtctttctttttaagggtttcacttcagaatatgtgtgtttgtgtatgcatgtgtatatacatatgtaataaaaatcagatatattcaaaagt

SEQ ID NO: 6372 - DNA, 633 bp, Homo sapiens
tccatattgattgcaacttgtgtctcattctgtcatctaaatcatgtggtttagagataggccttagtgtccacctggccaggcacaagtctggcgttaaggacctacctgctttaatgatccactctcagggagtcagaacagttaagtactaaaaagacaaggatctggagtgagagtccctagggctatgtcactggattcatgtttctttatgggcaagctacttaacatctctgcatccccatctctcaaaataaccataacactacctacctcacaagggtgctgtgaggcttaccatgaaaagcatgaggaaatggtatatagaattggggacctagtagaaaggggggggggggggggggggcgggggcgcgggggggtgggcggggggggggcgccgcgggggcccgtttgccagaatatgtctaatctctttacggctagaatctaaaatggtgttggccatcgattggcttaggttatctttaatgtcattgacttttacaaaattcgtaacgacacctctttctcagagagatgctggattggaaaaattattaaattaattttaacaaaggagaacaaaaatgattcacttccaggtgctgggtgtggcggaacagttat

SEQ ID NO: 6373 - DNA, 341 bp, Homo sapiens
ggcatgatcactggcccaacagctgtcaaaagttccttaagattcagggctcaaaatgtttgtgctggataggcctttagcaaacttctctgtcttattttaaaaatgaggaaactgtcaggtgcggtggctcacatctgtaatcccagcactttgggattacaggcatgaaccatcactcctggccctcatttaaaaattttctaaccttgattgaccatgggcaaatgaaactgcagaaagtgaaactgcggataggggggatgactgtattcaatagattccgacattatgtctgcaaaacacttgtatgataaagtattaaacttttgttgctgttg

SEQ ID NO: 6374 - DNA, 416 bp, Homo sapiens
ttttttccaaacattttgctcttactcaattttacagccgatctgtgagacccaaactccctcagatgttctgtctattccccatcctaaatgtcaggatgggagaacaggttaaaggggaaaatcttaaaaatatgcatatttaaaattttaaaaacatctttggaacatgtattttaaaataaatgtaagtcagcttgagtttaagggcctcagtaatatccctgataaaaacaagagctacattctgtaattgctatagtccatgataaataaaaaggaaatatacattttgtacttacagagaagccactgtataatgacaacctacttgtaaacacaatctgggtttactaacttgcatctgataacaatgccatacacagggcatcaagtcctagagggtcaaggctgcg

SEQ ID NO: 6375 - DNA, 584 bp, Homo sapiens
atccgagatcgcaccactgcactccagccagggcgacagagtgagactctggctcaaaaaaaaaaaaaaaaaaagttaatagaatgagatgggaaatgtttggcctgcctacatgaagataacctgtccatcttcactggtggattgagtatgtactcttttggatagttcctgcccgcaagaggagaaagttgctaagccagataaattctttcagattttattaatcagttatgtctaccacctcctggaaggtaaataaaataagagaggccaggaatgccaggtgcagtggcttattcctataatcccagcactttggaaggctaaggcaggaggattgcttgagcccaagagtttgagaccatcctggaccacatagtgagaccccccatttctaccaaaaaaaaaccaaaactaaataataacaatgaataataataataaaagaccagaaatatgtttagagagaagccctcttcatggaaaccagaaagctggagaaaaggcagttttctctaacaatttatacctatatgattgataaagtagttagaaactttaccattcattccaaaaaatct

SEQ ID NO: 6376 - DNA, 456 bp, Homo sapiens
aactttgtattttaggattgatgctgatggatctagtacttccttaatccactttccaccccagaataaggtttgtccctttccttctccctccctgtctctcccttctctcccaccctctctctctctcctctctccccaaataaatgtcctggcaaaaggaagagtccctgaattgttttgctctgtgtcacaacaacattttatttttcttaaagtttgctggtttacatgtccacacacctggttttgaggcaggtatttttcttgtgccacttatttctctcctccataaagtctccctccaaacaaagacttgttatctgaggtaggaacagagttctaagaaatttcagccctagaaggcccccagaatgcatgaacagctgccttcacaattaaagccaaggtcttgggagaagggctgtggacttgctagaaatgatgaatgggagt

SEQ ID NO: 6377 - DNA, 499 bp, Homo sapiens
ggctgccagcagacagcagtctaggcccaggggcttccatcttgtgccatgtactttctctggcaccttgacccaatcatttttagctctgagcctccgtttcctcatctggaatagaataatacctgatataacagccttgcagagcagctgtgagtttattgatatcagagcccatgaatgtggaaaggctttgaaaacggacaaaagcacaggaaaaaaaaaaaaaaaaaaaaggtaaggcggcatttgctccgcatctggtttccatattgtctcaggcattttgtgttcggagagctgcctgggagacagctgcttaagttccaggtttaggcctcagggtccccagtggtgaagagaagaatttctggataataagaataaccaggacatggtattctacccttcatagaggcctttttttttgcaggagggacctcatttcgtcctcacaggctactggtggaaccataggacaggtattgcaaacaccatt

SEQ ID NO: 6378 - DNA, 282 bp, Homo sapiens
ttagattcagtatgttgatagctacaaaatagcttgctagaattttgactggggttgtactgaagaatctacagatcaaatagagaagtactaaaattgtaacaatgttgaatatttcaatacataaacatggggcatgtcatcatttatttagatctgtaatttctttcctcagtgttttgtaatcttctgcaacagatattggacatactttgttagatccatgctaagtattctgttctattggtgccattatagcattggtttttaaatgtgaaattc

SEQ ID NO: 6379 - DNA, 440 bp, Homo sapiens
aatcagtaaacaaggcctatctgttctaccatggaaataatttctctggagtggctcacagtcttccaacaaaatctttctaaacatgtgtcataattatataaaaagtaaaaggatgtgttgctggatgttagatgaggatgcctatatgtttttaagaaggtcactaaatgtcaagtttaacctatgactagaaaagaatacgtatgtcagaatctagggaaagaaggcaaagaggatgctgtaacactgcaagcagggcattcttcttattccatgacaatcattgtctatccactgttggcaaaaacaggctacaggggcagccctttctacctttctgaagtatcccatagacatttcatttagggaggcacacttgggttagaagaacacagcaggaagaggggcttcaaaggcataaaattcagggctcctct

SEQ ID NO: 6380 - DNA, 626 bp, Homo sapiens
aggtccatgagacagagaactttgccaaggctttacaacacagaggcactccagtaagtttaaaagaaaaggctgaaagccaaacacattgctttaaccaaccaacaacaacaacaccaaaagggcaagcctatcttatttctataacctactggtgagacttccttgtggacgtcactatatcccaggcagattcaagtgttcttctccccaaaacacacacttggcaagtctatcactgcatgttggccaacccatgccagtaccagccacacaggaatctgcgctaaagacctactgtaccttacaactcaagggaatgtgagaactgtgtctaggaagaaacaaaacaaacccgtcagcaatttaaatcttaggacaaccttaggacatttgcagaaatctggacatgtactggataccagataatgtttcagaagtacagttttcttaggcctggttattcttaggagacacatgcttaaggatttaggggtagtgtcataacatctgccacttcaatggtaaagaaacacacacacatgcacacacatacagcaaaatgttaggcaggttgaagagatacataggtgccctaagtacagcaggctccatctcctaaatga

SEQ ID NO: 6381 - DNA, 564 bp, Homo sapiens
cagtgatgggcatccagagagctggttatcaaacggcgcagtcagctggcaaaagccgaaacgtgcagttggcacatctggacggagccgccacagccgagggtgaacaatgactcctggcaagcatccaaattgcttgcagacgctagcaggtctcatctacaaccgcccctaccagcatctctctctctctctcttttttatgagaatcagattttcattgctccattcaattgctctcctctgccattttttacagctcttatcgttcccctggaatatggccttgagacagctcatccgtgtccttcactgtgttatctcttctaacttttattaaaacttcagctttcatctgaagatagctaattaaatctggaacagattatatgcctccccttaaaaagagcacaaaactattttcttcaaccccagcaatgctttttttcctttccaaaaggtaaaatcaaaggtgtttaagaagtctctttatttacagagctaagatattcaacacgtcatatatgagttgatttatattaaagttgtctgtgatatgacaaa

SEQ ID NO: 6382 - DNA, 283 bp, Homo sapiens
ctttccaaagctgtgttcattaacgcaagccctgactgcttcttaatgcatgaaatctgtcaattcacttgttaattcatacattcacttcattcattcattcaccaaatatttactgagcacctgctatatgccaggcaccattccaggaatattgacacagcacagcagcaatcaaggctgactttgctttgtccccagggagtgaccatttcttggggaggatatagacaaacaagtaaatatctaagtaaataagtctatactgtaattcaacagatcc

SEQ ID NO: 6383 - DNA, 502 bp, Homo sapiens
gctttcttattttattgattaaaacatcctgagattcagaagtagggactttgtgccagggccctggaggcagtccctgccactgaagagatgaccctgctttccgggacttcccggaggcttctgtctgtagaccagggagaaggtgttcgccggtggctcctgagtggtagtaaaagacacatggacacaggaagctttagcgttagaagctgctctcaaatatctcaacagaaacacacagtgtggccgcgcgcggtgcctcacgcctgtcatcctagcactttgggaggccgaggcgggcgggtcacctgcggtggggagctccagacacagctatgtgaaacgaaagctatctgttgctgtctcagattccataaggactgagacttgtttcaaaagaaactgaaattctgtcttgttctcagtaatgaaagtcttttataccataattgtatatataacttctgacttacaggaaaattacaaaaattcccatatc

SEQ ID NO: 6384 - DNA, 406 bp, Homo sapiens
aaattaactgaacccaagaagggggtcatgggaaccccaatttatggctggtcatagacacaggtcacaacctggagcatgcatctgaagtggtgggggggatggcgccatcttgtgggactgagaccttatcctacagcatttaacactatctacaggtagacagctgttagattggaactaaatcatagggcaaccagctgttcttcactggagtctatggtgtcagaattgcttggtgtccagcaaaacaatctccatacatttagtgtaagaggtgctgtgtggccaagtgcatatgtggctcactcttgtaatcccagcactttgagaggtcgaagcagaaggatcacttgaggctaggagtttgagaccagcccaggcaagatagcaaaactccgcctct

SEQ ID NO: 6385 - DNA, 951 bp, Homo sapiens
tcagcacacccacacccaccataggtctctctcctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatccagagtccaggagtctgaagtggggccccaggtgatgtcattgctgctggtcccaggaccacattttaacaatcaatgttttcagatgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacccgggtgtgtggacatggatgcg

SEQ ID NO: 6386 - DNA, 435 bp, Homo sapiens
tgtaatttctcctgccatacatgtagtcattgtaaaaataatagtgtaagggtaccttttataaaactgattattttccaaatagactggtaccttttggtttagaaaaaaaatgatggaagaagattgtagttcaggagagcaagcagaaagcagtcatttttcagcctttcattttattgtacctttggtcacatttttgaagaaaggcccaaaattgccatatgtatgaaagaatattggtaatggggtagagttggaatgaaagtgagattttcagagtaacaaggtcactttcttctgtggcttgtagaaacagatatgtgatcacaacaggtccagcagccagggttggggggagtagagagttcatgtaatttgtatcatgcttaaatttccatatttgaaaaagcaactagagaacaggattttgtc

SEQ ID NO: 6387 - DNA, 681 bp, Homo sapiens
actatatgcttctggattccttctgatccacactatgctaagttttgccaggtatcttaaggggtggctggaactacactgagcagattgcatcacattttctacaactgcagggaaaaggggtaagccccccacacttcccacaaatccagacagcatgtacacaacctggtgttctctcaggacaactcagtaggcacagccaggtccaactagccagcagtgctaccaccgtgccttgtgatttttttttttttttttttgaggcagggtctcactctgtctacccagggtggagtgcagtggcttctgggctcaagcgattctcctgcctgagctgcctgagtagttgagactaaaggcgtatgcaccacgtctggctaatttttgtatttttggtagagatggggtttcaccatgttggccaggctggtctcgaactcctgacctcaggtgatccgcccaccctggcctcccaaaatgctgggattacaggcgtgaccaccgcgcccagctgtgacctctttttataagttctttcttcatacagaaaactttggaaagagggagaacataaaattttctaagttttcacctatgttggttaaagaaaaagaaagtaggttattcagttagtaatgccaaagctagaaccatagaaagaaagatactttttttcct

SEQ ID NO: 6388 - DNA, 3111 bp, Homo sapiens
  misc_feature (49)..(49): n is a, c, g, or t
atgtactcccaattacttctggaagtttctcaaagtactcctttatatntactgcagagtgtatttttcttcctcctcaactgagatctttccaacttgccaccatgcagctgccaatggtcctagttaagtaaaatgctgccatacctattttagactcagggaaaaatagcacccactcatttttatttttgctcaatataaaaatgaggatacttatgaggatacttaaacttttaggattagctagttttctaaaaatcgaattattcactcctttgtaaagtatgtaataggaatttgctctaataatcaatagattaaggtttaaaatttgaaaccatagtaatgtatgtttaacaccaatattttaagcctttttaaaaaccacaacccacattaagaaatacatttcatactgtgatcaagtacacacgcacacacacactctatacatatatgtctgtccaattaaaagtttcacagaaatttccaaggaggtatgctaaatattatctctttgattctactttatttttaaaaagtggtatcaacccacaaaatggatttcataacccactacgcagtttgataagatgctgttttagaccatgcttttcaccagttttgtggtcctattttgtccttttcatgtctatacaggatgcttctagtgctagttgctagcttttctctgatttccaggatggtaataggttaagaatttctctaaatggttatttcttttctttctgcagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6389 - DNA, 902 bp, Homo sapiens
aattgatgtgcattgctttgtgtctgaaaattaatcaagaccttttatttgcagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6390 - DNA, 813 bp, Homo sapiens
aagcagttgtatcaacgcagagtgcccattacggccgggtagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6391 - DNA, 829 bp, Homo sapiens
  misc_feature (566)..(566): n is a, c, g, or t
cttcttcaatagccgtcactctcacgtactacaagagacctccaggggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacaggctactgcttatgataagaatacaccctgtttttatttacgactttttttttttccccttttgaagtttttcatttaggcatcttctttgttttcactttatcggacaatcgctcagaatgtccgatgccagcccccagcgtacaccccatatcccgctctcttccccctccgcgccccttccaatttcactactagtcctttgtccccactcttgtgcctcacattcgttcctgttccttctcgtcactgcccccctcccgcccccctgtctttcagattttccacccatccccgccacttgttctatcttccttttagcnctctttccttattttttagcgtcgcctgtacccccccactggaccttttctcaccccccccctccttgaccccccaattctccctcgtctcccgcccaccccaatccatttctcctcctctccattcatgtcactattctcactcctactcagcccccatacatgcgtgtagtgtgatctgtttatcgcgactccctattctccccgcttccgcgtatgctcgtactcactcgttttatgctctgaatacgtttcactgtcac

SEQ ID NO: 6392 - DNA, 2517 bp, Homo sapiens
agcgtggtggcctctgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6393 - DNA, 2267 bp, Homo sapiens
agcgtggtggcctctgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6394 - DNA, 2420 bp, Homo sapiens
tgtggcagtgtaggtgtagagaggcggaatggagacaaaattttagcctgacattaaatcatttggaaagtgatacaggagaggactctgctatgaaacttcctgagtgaaatgataagtggcatgaagaaaaacaaagcaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6395 - DNA, 2401 bp, Homo sapiens
taagttgttccccaacaacaaccactgagcctacattaatctttttgaaagtgatacaggagaggactctgctatgaaacttcctgagtgaaatgataagtggcatgaagaaaaacaaagcaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6396 - DNA, 2666 bp, Homo sapiens
agcgtggtggcctctgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggaccttcctctggggttagttctctggtgccaccttcagtgatctgtgtggcagctctgctgctcacttctggctttactgggttttggtatttaactgttgcttacgcacactggaaattttcacctgcagtttttcttctgcctaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6397 - DNA, 2400 bp, Homo sapiens
aaacttaggctaggtacgaggctgggtggtgggcgtatgagatgcaggcctggagtggggaggggcgtagtgagatgcaggaggagatgagccagaagttaaatcatttggaaagtgatacagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6398 - DNA, 2356 bp, Homo sapiens
  misc_feature (77)..(77): n is a, c, g, or t
gggtgcagaattccgggctcagcgacagcctgcgccgagtgtgcgcacctgtcggagacccgccagtccgccggccncgctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6399 - DNA, 2183 bp, Homo sapiens
  misc_feature (77)..(77): n is a, c, g, or t
gggtgcagaattccgggctcagcgacagcctgcgccgagtgtgcgcacctgtcggagacccgccagtccgccggccncgggccactacttctcagcacatccggccttctggctcatctcctccctgcatctcactacgcccctccccactccaggcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcaaaaaaaaaaa

SEQ ID NO: 6400 - DNA, 312 bp, Homo sapiens
aagacatttcttagtcttggaggaaattttttattaaatataaattactacctctcaaagtaaaatttacattatatctataacaatatgaaatatcttatttagctacaaccagatactattatttgactgtttagaacacagaacaaaatccttctaaaaccggtaccttggaggatgttgtctttctttgaattaaagccacaactaacaagccaggcacagtggcaagcacctgtagtcccagctacttggaaggttgtggcaatagaatcccttgagcccaggagctccaagcccagtccaggtaac

SEQ ID NO: 6401 - DNA, 296 bp, Homo sapiens
agtttttacatgcacttttgtgtgtgtgtgtgtgtgtgtgtgtgtgtgtgcgcgcgcgcgcgcacgcgcgtacgtatatgtgcaattattctttgcagttttatcacatgtatagattcatataactaccaccacaaccaaaatacagagctgttccatcaacacaaagaaactgccccgtgctattcaggacacttttgaaaaattaatcatcacaatactgctgtcacacatcaaaagacttttgttaaaaatttctactgttaaggaaataaacagccgttattggactatca

SEQ ID NO: 6402 - DNA, 367 bp, Homo sapiens
aaaagtactgcccaagagggatcttatgaaactggagtaatttcttccagtttcattgaggtattctatttccattcactttagttactagaaggcttttagtacaactgtacatttagggtaataatacattagttggattcaccccaatcccaattgtagaagttttcatttaatcttttttttttttttttctcagacagggtctggctcttttgcccatgctggagtgcagtggtacaatcaaggctcactgcagcctcaacttcctgggctcaaactatcctcctcagcacccccatcctcaaatagctgggactacaagcgcatgccactaagcccagctaatttttaaatttctttgtag

SEQ ID NO: 6403 - DNA, 440 bp, Homo sapiens
aggggtctcataatgctagccaggctggtctcgaactcctggccttaagcaatcctcttgcctcagcctcccaaagtgttgggattacaggcatgagccaacacacctggctaaaactgcatttagaaaacaattttgtcagattgggcatggttcctacacattgtgtaattttatattcttaggaaggtttttgtctttctctttccagctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagct

SEQ ID NO: 6404 - DNA, 442 bp, Homo sapiens
agttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagct

SEQ ID NO: 6405 - DNA, 274 bp, Homo sapiens
tatactaaaataacagcacataatatgatgaaaacctgaagcagtttcctaagtgactgatgcctaactcagctgaatattgacttacaaagggacttcaagtatagacctaaggaggttgctacctacctgtctctgagattctcgtggacttcagtgtgaatatagtaatggaacacctgaaaaggaagggagtaatacagaagaaaaatggtaggcaaagaaaatggggtgtagagaagcagactactgtgcctccatccctttccagaaa

SEQ ID NO: 6406 - DNA, 745 bp, Homo sapiens
ggacaaggcacatctagggaagaaaagggattggtggttgccagaggctgtttcctgattgtgctgaggcttacagacacagctctgtgtgtgtcaaagtttgaaaaacctgcattaaaaatgatgagtttattttactgtatctttacgctttaatttttaaaaatgaaaaggaaagaaaaaatgcttgtagcatccctacttctcccccaacccccgacccccccaaaaaatatatatatgtgtatttttagacatagtctccctctgtcacccaggcttgagtgcagtggtacgatcaggtgcacgccaccacatctggctaatttttaaaaatgtattctagggacagggtctccctgtgttgcccagggtggtcttgaactcctgacctcaaagtgatcctcctgtctcagcctcccaaagtggttacatgcatctatccatgtgttaaaatcggtagaactgaggccgggaacagtggctatcacctataatcccaccactttgggaggccaaggcaggccgattgcttgagctcaggagttcgagaccagcttgggcaaggtggtgaaaccccgtctctaccaaaaatacaaaaattagctgggcatggtggctcacacttgggtagtcccagctacttgggaggctgaggtgggaggattgttggagcctagaaggcggaggttgctgtgagccgagatcgcaccactgcactccagcctgggcaacagagggagga

SEQ ID NO: 6407 - DNA, 519 bp, Homo sapiens
tgtgtgtaaatacactttgtgacattcacacaatgacaaaacccactagagataaatttctcagaatgtatctctatcattaaatgatgcatgaccatatttctaatgcaaattaaaatgccatcaagaccatcttgatttatttttccttccagagctattagtattagtaatgaagttctcttaatctgacctagtttggggtgaagaataaatacctaatccagtattacagaagtatgtgggtaagttaactttaacagtgtcatgggctcactcacattctgctcttctgattgggttatctgtaaaaagaacagagatctgtggagattttaaagagtgctcatctcatctgaaaaccagccaggcataatattcctaggttagtttttagccaagaatcactcaagtttaccgtagatctcctgtctttgaagcattaacatagacacaatacatatgggatcccttaactgttcctggaggtatcagaaagtaatctaaatcctgagttta

SEQ ID NO: 6408 - DNA, 434 bp, Homo sapiens
cagggttttttttttctctttaattttagccaatctagtaggtgtatagtggtatttcagtgtggttttaattttcatttcttgatgactaatgatgttgagcatctttttaggttctttttggtcatttgtgttttcttgatggagaatctgtccgaatcttttgcctttttggtactgggttaatctgttgttaagtagtaaggactgtttatatattctagatacaagtcctttgttatttgtgttatgaatattttctcctaatctgtaacttaaaaattttatataaagaaggttttggcctagtatggtggctcatccttgtaatcccagtgctttgggaggccaaggtgagaggaccgcttgaggccaggagtttgagacgagcctgggtgacacagtgagactctgtctctacaaaaataaaagta

SEQ ID NO: 6409 - DNA, 209 bp, Homo sapiens
gcttcatggccaactataattattagtcctctagtaagcagcaacacaaatatacctactcaatagcattaagtgggaacaaaaaatatttcctactttaaacaaaatttaaagctagattcagaattaaataatgactctataatatgtaaacaaaaaagcagttatgatttttttaaacgtgttatggagtcttacaaggcttagat

SEQ ID NO: 6410 - DNA, 341 bp, Homo sapiens
tgcccacagccacggagcaaaagcagggctggcatttcactatgtaattttgagagtgaaaatagattcatgctcagaaacacacacctctcacaggcctgggtatttaaccgttgctaggtctccttccatgaaagcaacaatctcgtttaattcaactttccatccccagggcccactcctctactcaataatgcacaaagtggatgaatgcatccctaggaatcactgctgaagaacaagtggcatcagaaccaacgggacactgtttccttcagtgctatgagatccgacctcatagtccagggggatagatacaatccaccagtaagtccactaaa

SEQ ID NO: 6411 - DNA, 442 bp, Homo sapiens
aacagattatgttggtatcagccgaaacctggactttgctccaggcgtgcgcatgcagacattccaagtgaccatccttgatgacctgggacagcctaccttggaaggccccagagaagtttgaattacttcttcagatgccctatgggtgcagtgcttggagaaccaaataaaactaccattttcatcgaggacaccatcacggactgtaagcagagtgcttgtagttcctttgattgaaagactttaagagggaaaaaaacagccaagatatgtctcctaacaacagaatgaaactctactgtttatagatcttagcaattctgggatatcagtgatattgtactgtcattggtgttatattctggtgatatgtggaaatgtaatttatatgactgcatggagatagaaatatatatacctagaaaacattgagcccaca

SEQ ID NO: 6412 - DNA, 553 bp, Homo sapiens
aacagattatgttggtatcagccgaaacctggactttgctccaggcgtgcgcatgcagacattccaagtgaccatccttgatgacctgggacagcctaccttggaaggccccagagaagtttgaattacttcttcagatgccctatgggtgcagtgcttggagaaccaaataaaactaccattttcatcgaggacaccatcacggactgtaagcagagtgcttgtagttcctttgattgaaagactttaagagggaaaaaaacagccaagatatgtctcctaacaacagaatgaaactctactgtttatagatcttagcaattctgggatatcagtgatattgtactgtcattggtgttatattctggtgatatgtggaaatgtaatttatatgactgcatggagatagaaatatatatacctagaaaacattgagcccacaaataattagactgtgttcatgttctttttctattttgttttactttgtttctgaggcaagtaagaaatccactgtgatcaattaaatcaaaagttaagatcaaagaattaa

SEQ ID NO: 6413 - DNA, 362 bp, Homo sapiens
tttaagatattctgaaacagaattatactaattatggggtttttaaagttgaactctttttggcttaaacacaaatttattatcttatagttctggaggtcagaagtcctaaactagtcttacggtgctaaaagcaaggtgtctgcagggctttgttccttctgaggcggtaggggagaatgtttcctccttagcttgtggcctctgcttccatcttcaaagcacatcattccagcctctgcttccgttgtcacattgccttctctgactctgaccctttttcctccctcttataaggaccctttcaattacattaggcccacctggataatccaggaaaatctccacatctccaagtcctt

SEQ ID NO: 6414 - DNA, 706 bp, Homo sapiens
gtgcccacatgggtaatagagagggcgaacatgtcaccaccttgatccactctaaactctgtacagttgcttataggcagctctagagccgaaacaacatggtgattgaaagcttggacacagatccttccacatgtaaatagtgcccactcatagggggaaaaaaaaaagaactataaacaagagatgacctttttctaatttgtatcacggagtatcaaatgtgagggtaaattgcttcaacttctattcatgttgattgacaaaataaaatacattgttctttttgtttgtttgtttgtttgtctgttttgagacagggtctccttctgttactcaggctggagtgtagtgacccaattgccactcactgcggcctccaactcctgagttcaagtgttcctcccgtcttggcctcccaacgtgctgggactacaggcataagccactgcgcctggcacctgtctaggagctccaaaaacacaaagtgttgaagttttagaaacactaacaagaggctctgaaactttaagataaagaacaatgaaaggaaaagcaatgacattcaataatgcaaacacatcattgccgggatctggcacagtaattctcagtaattctcatctaactgggagaatatagtatatcccagcccctccccctccaccatcctcttcttcataaatcaggcaaaatgcctgattaa

SEQ ID NO: 6415 - DNA, 7238 bp, Homo sapiens
  misc_feature (5875)..(5875): n is a, c, g, or t
tatttgaaaatactggatttaatagaaaatatcacattgtaaacaaatccattgatccatgagcttaaaacagaatgacggcacaatcacatagaaaagctaaagacaaaatactggtaccaaacatagcccttaggcctgggctaggctctcaaaggtctttcccagaaatggaggcagcagtagcttcaaacaggcacaaaaacagccaggaggaggcaacatccactccatgaaggcctaagacaatgaaaggaagccagagcaacagaccaccttgggatccggggagaagggtaaatcgggcaaaagggttgtatttcctgatgctctcagaacatcagaccacaccatgtgaatttaagcaggactattttaagtggggaaacaatactagaagcatttggtgtattttcctggcactcacctcctaggtaagcaggagagcgggacactcaggagttgtgactaaactcacacttaagctgcctgtccagaccgtccccttggctgaacacaacactgaaattgtggcagtgtctgttgccccagtggacctcccacttactaatgagtatgtaaaacagaggagccacagtgaggcctttcacaaaaacacagggctctgggggaaaaacggcttccaccttctgccttttggtgctggagagtccctgagggagagaagtttgacgtggctgggccccttgaggctctggatttatcaatagaagcctcctctttggccccacccacccaaatccacccccaggttctcctagttcagagaaaagctgtgaaagtggaagaaggaagggatcgttttctttccattgcacttgttactgaccaaagagactgcttccttgcacttattttagatattgagagtttgtgccttcacttggaacaatggttctcaaccaaggggcaggcctgtgcaagaaggactctcaagaggtggtatccaatatacataagcccctaattccctcccacttgaaaatcagtgcgtgtaaggagagaaattcctgacgggagtgtgtcatatgtgtgaaccatggctgaagcagaacaaaaagtttaaaactcccaacctgggtttggcagacatcaaaatgatggagtacattttgcagatattttttttctgattaagttacaaacattctccctatagctaaactccgtgactaggctcccagcctcatggccaagaacaataagttcacccacttatctggagtaaccatactagattaaagaaatacaattctttcttctaaagacaatttccagaaagacctgcctttccctatgggtacttgacactaggtcccagcacaggctaatcgctgtatggtttcttcgaagattggcttttcctcgtgccgaattcggcacgagaaaaaagaattagtaaaacgatgaaaaaaatcatacatactgttcgaaaatggctacttagatggtctagcctgctaaatctttttccacaagcttgacatggatagggcctttctcctgtatgacaacgaaggtggcgctttaggtctgccttccgcttcaccacatgtgtgcagtacgggcacttgaatcgcatccgaggcagatcatctgtcaagagacgctttgattaaatcactggaaagttcataacaattctaataacagaaagaatccaatccaagcccaatggaaacaagagaaagaaaaaaatctcgtgccgaattcggcacgagggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctcggttccgattcggcacgagcggcacgagcgctgagcagcggagggggagcgtgcagagccgctgcggccctcacagtcggacgccggccgtgccgtgccgtagggaacatgcacttttccattcccgaaaccgagtcccgcagcggggacagcgggtccgcctacgtggcctataacattcacgtgaatggagtcctgcactgtcgggtgcgctacagccagctcctggggtgcacgagcagcttcggaaggagtatggggccaatgtgcttcctcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagnttcgagaaaaagaggatggagccttttctttttggtacggaagttggcaagaggtttggagctgccttatgtgtcttgtcaccagccttcggagtcaagagtataagattgtgctaaggaagagttattgggactctgcctatggatgacgatgtcacggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcaggcctgcacgctccgcctgcctggccagcaactcctgagaaggctccttccgggtcacccgcatgcgatgctggcgggtcacctcctctgtaccattgcccagtggaagcacgagcccaggccggggccggggtgaggtgcgcctggaactggcttttgaatacctcatgagcaaggaccttctacagtgggtcaccatcactagcccccaggctatcatgatgagcatctgcttgcagtccatggttgatgaactgatggtgaagaaatctggcggcagtatcaggaagatctgtcgccggcgggtggggggtactctgagacgctcagacagccagccaagccagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaaggggcggaggggtcttttccttcttctttcctacctaccccttttctcttgccaggggcctcgtatcctacctttccttgtcccctgggctggctgcacagaggattgccccttctcttttcagatctggccctcgatgccaaattagcatttagtattttgcacaaagtctaaggaccatggctgcctgcttgggagaccatagctcctctgggccgcttctggcctcttggagggatggcaaaggccaaggggatgggagaggtctgtgtttggtctcccggagttccccatcattaaactcaccgtcgactggtcctaaaaaaaaaaccggacgacgtcgtgccgaattaat

SEQ ID NO: 6416 - DNA, 6465 bp, Homo sapiens
  misc_feature (257)..(257): n is a, c, g, or t
  misc_feature (5102)..(5102): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctcggttccgattcggcacgagcggcacgagcgctgagcagcggagggggagcgtgcagagccgctgcggccctcacagtcggacgccggccgtgccgtgccgtagggaacatgcacttttccattcccgaaaccgagtcccgcagcggggacagcgggtccgcctacgtggcctataacattcacgtgaatggagtcctgcactgtcgggtgcgctacagccagctcctggggtgcacgagcagcttcggaaggagtatggggccaatgtgcttcctcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagnttcgagaaaaagaggatggagccttttctttttggtacggaagttggcaagaggtttggagctgccttatgtgtcttgtcaccagccttcggagtcaagagtataagattgtgctaaggaagagttattgggactctgcctatggatgacgatgtcacggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcaggcctgcacgctccgcctgcctggccagcaactcctgagaaggctccttccgggtcacccgcatgcgatgctggcgggtcacctcctctgtaccattgcccagtggaagcacgagcccaggccggggccggggtgaggtgcgcctggaactggcttttgaatacctcatgagcaaggaccttctacagtgggtcaccatcactagcccccaggctatcatgatgagcatctgcttgcagtccatggttgatgaactgatggtgaagaaatctggcggcagtatcaggaagatctgtcgccggcgggtggggggtactctgagacgctcagacagccagccaagccagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaaggggcggaggggtcttttccttcttctttcctacctaccccttttctcttgccaggggcctcgtatcctacctttccttgtcccctgggctggctgcacagaggattgccccttctcttttcagatctggccctcgatgccaaattagcatttagtattttgcacaaagtctaaggaccatggctgcctgcttgggagaccatagctcctctgggccgcttctggcctcttggagggatggcaaaggccaaggggatgggagaggtctgtgtttggtctcccggagttccccatcattaaactcaccgtcgactggtcctaaaaaaaaaaccggacgacgtcgtgccgaattaat

SEQ ID NO: 6417 - DNA, 1906 bp, Homo sapiens
  misc_feature (257)..(257): n is a, c, g, or t
  misc_feature (949)..(949): n is a, c, g, or t
  misc_feature (972)..(972): n is a, c, g, or t
  misc_feature (995)..(995): n is a, c, g, or t
  misc_feature (1344)..(1344): n is a, c, g, or t
  misc_feature (1752)..(1752): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaaggnaacgtaccctccacggagcaagntggctgctggtgccggccgcctngggactgctgtgctccgcggttcgcggggttcctctggctgctttgcggtgcaggcatcccgggacccgagggcaaggaggtttgggagcctcggccgctgccgagcgcggggcttgggcggcacccaccagagcgcccccggctggctcttagcgcccgaaactggctcgcgagtcccccggcttcctcgccccggcactccctggtagcctcggtctcccgcagcccccgctcggagagctcggagcccgctgcattgcggtgcatgctccttagctctggggcagagccagagctgggcgttggggagaaaggggtgcctctggccatccggctcctggagtactngcgcccgtctgctcccaggcacggatacgcttctgagcagccgcgcgccacctccttttctccagctcgcagtccacgggctagtggactctgcttggcgtgcaagcactgcgcgcgggggccggagaagctctgccgtggtatcccgcaagtggccgccgaaggagaggggtggagttcattggccgtacccttggggaccagtctggtggtccgggcgcctgcgggactgcacgtttccagggtcagtcggggagaggtggaaacccttttcgcctcttgagccttggaacaggagtgggctggggtgagtggtcggtcctacctaaagtctcccagcctctccaccaccccggagaggatactcggcggccgggagtcgtcgggcagcgtcactctctgccagcncagacttggcggtgcctccggcttggtggctgggaaagcgcgctccaaagacaccgtgcccggcgcagcggggagcctggggcgctcggtagcgctcgcgaatccctgtgggaaatcccggcccagctccccgcctcccgccccttcccccgcc

SEQ ID NO: 6418 - DNA, 5193 bp, Homo sapiens
  misc_feature (257)..(257): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaa

SEQ ID NO: 6419 - DNA, 4647 bp, Homo sapiens
  misc_feature (257)..(257): n is a, c, g, or t
  misc_feature (4576)..(4576): n is a, c, g, or t
  misc_feature (4589)..(4589): n is a, c, g, or t
  misc_feature (4608)..(4608): n is a, c, g, or t
  misc_feature (4638)..(4638): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaaaaaaaccctgttttcccggtggngccaaaaaagccnccccaataatggtaatggncctgggggttaataaaaaaaggaactgggnggctttggt

SEQ ID NO: 6420 - DNA, 5070 bp, Homo sapiens
  misc_feature (257)..(257): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccactggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaa

SEQ ID NO: 6421 - DNA, 4922 bp, Homo sapiens
  misc_feature (257)..(257): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccactggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaaggggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaa

SEQ ID NO: 6422 - DNA, 4089 bp, Homo sapiens
  misc_feature (257)..(257): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaa

SEQ ID NO: 6423 - DNA, 5142 bp, Homo sapiens
  misc_feature (257)..(257): n is a, c, g, or t
ggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgnggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaa

SEQ ID NO: 6424 - DNA, 4464 bp, Homo sapiens
tttttccacgtgtgaaaacatctattggggaaatggaaaaatcatttgacctcatattcctcatagctgacatgacaaaaccaaaatgtggtggtgagccaacttcaattttgcagaaactgacttggaaagaactgattacctgaaggaccgtgaggatcaaagttgtcccactgaccaggctgtaaactttggaactgataagtgagagagataagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttaggggaaggctgatgaaggtaaacacagaagtcaggagctttgggcctcttactcggaatggtttttacctcgcttttcaggattatggtgcctgtatgattctactttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggacggggaatggatggtgcctattgggcgatgcacctgcaagcctggctatgagcctgagaacagcgtggcatgcaaggcttgccctgcagggagattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagagctccatcattctggagtggcaccctccaagggagacaggtgggcgggatgatgtgacctacaacatcatctgcaaaaagtgccgggcagacggccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccagtagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaaaa

SEQ ID NO: 6425 - DNA, 268 bp, Homo sapiens
cagctatccctgaacatctgaatcactctggagttttttaaaaaatgcaaatatcctggtcccagtctctcattcttggggtgagggggcaaaagtacctgtctctgggtattttttctttcatattgaaaaatgcatttaaatgcaagacaattaactactaatattccttccatctattatcaaccgctgttaacatttggacatatcactttcattttttcctgtgtcattgcagtttcaaatattacaaattaacatatcattt

SEQ ID NO: 6426 - DNA, 421 bp, Homo sapiens
ccagagatttgttgggtatgtggaagaacttctcagaattgactaagaattttcttggaaatttcttggaaacatttaaatgattagtgctgaagttgtgggagagtaatttccttctccatgtaagatgactagaaagagagagtgtgtttggttccggttacaaccccctgaagaagtgagacttcaaaagaaggccgtgctgcccacaggtcagctgtccactccttccatatgagggcgtctcctcccacttttgccacagctcatctctaaccctgctcctccgctcctcccaaaacagaaacttgaatggaaagtccattgctgatttgtcagagtggaaaggaccacttctccagaagaccgagttctccccttcctgttctgacatgtctgctttaagtaaatccgtatgcac

SEQ ID NO: 6427 - DNA, 899 bp, Homo sapiens
gaattactaaaatatcacacagagacatgaaataagcatatgctattggaaaaaatggcactgatagacttgcttgatgcaggcagtgttgccataaacctccaataaaattagtatataaagaccccaactccattgtccctcagatgaaataactctaaggaacatgcattacatttttccccagagtcgctcagtaggattgagtttcagttgtccaccaagaaaacacatgaattaataacacttgcctaataacacattattggctttcttccttccttgtctctcttctccaatcttctattaatgtttgttcggattacttccactttataaacaaactaaattcaaatctttttttcagagtctatttttggggaacttcaaaataagatagcaactaatctccaggtacctcaacttcccccgttgttaagtaagtttttcctctacatcatgaataagccatttttttttttctttaaagggccaaatacaggccttacagggcatactttcagctttacccttacagataatacataaatagatgagcctgtgtttcaataaaactttataaaaagagactgctgaccagatttagctcatgaactatagtttgctgatccctgctctaaattaattccaagttttttcatggtctaaaattcagtactgtatgcctctgaattcggacaacactttggaaatcctacaaattgcaagagattatcagtagctctataaagagattataaagtttataaaaatcaaacaatctaaaattgttgctaagcattagaatttcaaaatttattctctaatgataaaagtgatgtatttattactgttgttgtttttattatcttaaaagtagataattatttttattatat

SEQ ID NO: 6428 - DNA, 368 bp, Homo sapiens
tctttagaacagttgaaagtgggataagcgtaggagctgagttccacccccatgataaagaaattttattggccgggcgcggtggctcatgccggtaatcccaacactttgggaggccgaggcaggcagatcacttgagctcaggagttcaagaccagcctggccaacacgatgaaaccccacctctactaaaaatatatatatatatatatatatatatacatacatatatacacacacaaaaattagctgagtgtggtggtgtgtgcctgtagtcccagctactcgggaggctgaggcaggagaattgcttgaacccgggaggcggaggttacagtgagccgagattgcgccactgcactgcagcc

SEQ ID NO: 6429 - DNA, 944 bp, Homo sapiens
actctgccatgctacggggggtgggggggcggtcagtgcatgctgttcctagtctgaaacttgtgtcctgtgggtgcctggtggggaacccttgcgggaaggcctggtgggtttgtccctgcttcccagccagcctgtgtccccgggtatgggctggggtctggcatgggcctctgcagctggccacagactgaggggctccaaacagcactgggaacagcctcagggtatctggttgggggctgcagacaggggtggggtcttctgcttggccttgacaggttgcaggcaggttgtcagccggatctgcaatctcatgggggcttggggtcttcccggctcacgaggttatggcagaattcagctcctggtggctggggactgggtcccacctccctgctggctgttggcccttcccagcatggcggttgcttccccttcagggccagcaggactggcctgaatttctccctttctggcgttgaaacaccctctggagggcttcgtgatcgggccatgcccgcctaggatgctctcccttctgatgagctcaagtcaccggttagggtccttaatcacatcgacaacacccaccccacctggcgagtacaacgtgatcaggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 6430 - DNA, 828 bp, Homo sapiens
ggtcacgcgcccgcccgaaggctcctgtcgggacagggcgccgccccgtgtcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 6431 - DNA, 428 bp, Homo sapiens
cccagtaacatatattggcgagccagccaggaggccttcccagcatgtggaaggggccagcggggccagcgtgggtgactcagcagaccctgtctcaacccgtaggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 6432 - DNA, 846 bp, Homo sapiens
ggtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 6433 - DNA, 919 bp, Homo sapiens
ggtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccaaaccggaccataagtgctagtccgaaaaaaaaaaaccggggcctttgtggggcaaagtagaaggcctggttgttcgcccttttgaaagggatcgcggcctaggcgttatacg

SEQ ID NO: 6434 - DNA, 701 bp, Homo sapiens
tctagaggatctcccccgactagcccgacagaatggtgcccagaagtcctgggacttcatgaagacgcatgacagcgtgaccgttctcttattcaactcttctcggaggagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 6435 - DNA, 925 bp, Homo sapiens
actctgccatgctacggggggtgggggggcggtcagtgcatgctgttcctagtctgaaacttgtgtcctgtgggtgcctggtggggaacccttgcgggaaggcctggtgggtttgtccctgcttcccagccagcctgtgtccccgggtatgggctggggtctggcatgggcctctgcagctggccacagactgaggggctccaaacagcactgggaacagcctcagggtatctggttgggggctgcagacaggggtggggtcttctgcttggccttgacaggttgcaggcaggttgtcagccggatctgcaatctcatgggggcttggggtcttcccggctcacgaggttatggcagaattcagctcctggtggctggggactgggtcccacctccctgctggctgttggcccttcccagcatggcggttgcttccccttcagggccagcaggactggcctgaatttctccctttctggcgttgaaacaccctctggagggcttcgtgatcgggccatgcccgcctaggatgctctcccttctgatgagctcaagtcaccggttagggtccttaatcacatcgacaacacccaccccacctggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtgagactccagggttctagacagaggccagtcttggccactcaccccacaccccgcggaccccaataaaggcttgcatagctcca

SEQ ID NO: 6436 - DNA, 610 bp, Homo sapiens
ggtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcctggtgttggtgaagcagttccggccagctgtgtatgcgggtgaggtggagcgccgcttcccagggtccctagcagctgtagaccaggacgggcctcgggagctacagccagccctgcccggctcagcgggggtgacagttgagctgtgtgccggcctcgtggaccagcctgggctctcgctggaggaagtggcttgcaaggaggcttgggaggagtgtggctaccacttggccccctctgatctgcgccgggtcgccacatactgggacgctacgatgggctcctgaccccagctgaggtcttggggaaggaggagggtgtcacagacccccacccccaccagctgagcaccagcctccacagcctcctccagaggccagggcccgct

SEQ ID NO: 6437 - DNA, 413 bp, Homo sapiens
ggtcacgcgcccgcccgaaggctcctgtcgggacagggcgccgccccgtgtcggcccccgcagagctcgcggcccccgcctgtccgggcgccgccatggagcgcatcgagggggcgtccgtgggccgctgcgccgcctcaccctacctgcggccgctcacgctgcattaccgccagaatggtgcccagaagtcctgggacttcatgaagacgcatgacagcgtgaccgttctcttattcaactcttctcggaggagcctggtgttggtgaagcagttccggccagctgtgtatgcgggtgattaaacagacatttcccgtgggtaaatatatttgcaaggtggttcctggtattaagccttttgagtattaagaccggctcagcgggggtgacagttgagctgtgtgccggcc

SEQ ID NO: 6438 - DNA, 378 bp, Homo sapiens
taccaccaagacaaataaataaccacactgaggtacctggattttgctagaccgacagaaaagtgtaccattaagctaggaataatattaaatgcccaatatcataaaaataaagaggaaaataaagtccatggaaaatgattgcagaaaattaggaaatgaaacttcacatatagacactaaggagaccctaccattagcaaaaaataatcgagaagcagaagaaaactgttcagttggcattctaaacagattaagtatacccaaatatacgttgagaatatgagaaactacctcaactcagatagtcaaaaaataaaaacagaggccaggaaacaaaaaacagggataaataaaataaagtttataggactcagg

SEQ ID NO: 6439 - DNA, 346 bp, Homo sapiens
caataaaatctcatacctcattagtgagtcttatttactgtgaggaacttgataagctaacccttctccacatctaggatagttacagattctcttacaaattcatggcaacctcaagaaaggatggtgaaaaagcactaatgtacagtctcaggcatgatagatgttttttacatcatggggaatatgccaacaattatgagagttatgccattaatattccttacctgaaaatgccttgtatgtatgtgggtacccctttgaaataattaaacaagttatacatcagctagttgccttcagatagtcaacatctcagaacatgtcacttctcatggtaccaagt

SEQ ID NO: 6440 - DNA, 905 bp, Homo sapiens
agggtgggaggattgcttgagcccaggagttcaagaccagctggagcaacataccaagactttatctctaaaaataaattcacttttaaaatctctctgcagtcccattcctcacaacagaagatttttttttctgtctttaaaacttttcttccccaagtacctgactgtctctgactcctcatggcccagccaccctacacctaaccccttttcctgcctcttagatattcttcccaccatagccctatactctgtcccattttttggctcatttctctccatttttctttttcagttttgcattttatgcatttttctacttgtctcaataaaagcctggtcatagagcaatagcaagagaagttctgagctggtaaggaaggcaggatgtcatgaataagagaaatgaatcacagcaatggtgctacctggctaagatgcttcttctcttgtgtgtgtacttaggagaggtatgcaaaatgctttgtccaagtcaaaatccagggatccttagagctgtgctggtatttctgataggtgagtgggacagagatttgtttttagaaaaacctttttcaggaatgaattaatggcatttgcagcaacctggatgggattggaggctattattctaagtcaagtaactcaggaatggaaaaccaaacatcacatgttctcactcataagtgggagctaagctatgaggatgcaaagacattaaaatgatacagtggacttaagggactcagggcaaaagggtgggaagggggtgagggataaaagacctgaaactgggttcagtgtatactgcttgggtgatgcgtgcaccaaattctcacaaatcacccctaaagaacttattcatgtaaccaaataccacttgttccccccaaaaactatgg

SEQ ID NO: 6441 - DNA, 536 bp, Homo sapiens
gtctctacagctcagggaggttcactcgtgggaactgccttagctcaggaaaacacactgcttctgctcacagtacagtctgtcgggcacaggtcacaaggctccaacttcactgctggagaagctggaaaacaaacaggaagcacatggatatttgatgagctcagtctcagtcatccatacatttaattggttctgaattttctcatctgtgaaacaaggataatcaaatctgctttgttttaaggaattattatgagtttcaaatcaaataagcttttcctacagctcctcaaaacatgtaaactttaaacaaatgttaatatgttatttaaaaaggaaaatgatgtattttaacctagtaggcattttgttataccttcttatttattctcaatagaaggcatttaaaaagagacgttggtattcatatatcaataaggaaggcataactgtgttttagtttccgttgctatttactcctatcacattaggttggtattacttgggttagtttacagtacatcattaaagag

SEQ ID NO: 6442 - DNA, 386 bp, Homo sapiens
taattaagataatgtcttgctctgttgcccaggctggagtgcagtggtgtcttgctctgttgcccaggctggagtgcagtagtgtgattatggctcactgcaaccttgaacgcctgggctcaaaagatcctcccacctcagcctcctgagtagctgggactacaagtgtgtgtcactgcacccagctaatttttgtagtttttgtagagatgggattttgcaatgttgcccaggctggtctcaaattcctgggcccaagcaatccacttgcctgggcctcccaaagtatggtgattacaggagtgagctgctgcatccagtcttgtgctattatattcttaaactggtatttcaatgtaatgtttcaaaataaataactctaccca

SEQ ID NO: 6443 - DNA, 1534 bp, Homo sapiens
  misc_feature (1)..(2): n is a, c, g, or t
  misc_feature (4)..(4): n is a, c, g, or t
  misc_feature (7)..(8): n is a, c, g, or t
  misc_feature (10)..(10): n is a, c, g, or t
  misc_feature (19)..(20): n is a, c, g, or t
  misc_feature (22)..(26): n is a, c, g, or t
  misc_feature (29)..(29): n is a, c, g, or t
nntngcnncnggccagaanncnnnnngangggtctggagcttggaggagaagtctgaactaaggataaactaaagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaagaagttaccgccttcccatactcaggtaagactaggctttcttatcaataaaataaaaactgccagttgcattttttgaaatt

SEQ ID NO: 6444 - DNA, 855 bp, Homo sapiens
  misc_feature (1)..(2): n is a, c, g, or t
  misc_feature (4)..(4): n is a, c, g, or t
  misc_feature (7)..(8): n is a, c, g, or t
  misc_feature (10)..(10): n is a, c, g, or t
  misc_feature (19)..(20): n is a, c, g, or t
  misc_feature (22)..(26): n is a, c, g, or t
  misc_feature (29)..(29): n is a, c, g, or t
nntngcnncnggccagaanncnnnnngangggtctggagcttggaggagaagtctgaactaaggataaactaaagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgcttgagatgtgttcttggaagttctattgtatcactaaaggttgaaaagagaaggagatggatgaaataactcaccaaaaggaaacgaatttaagagccagatgctgatgtgttttcatctggtttaacatgagagcttgccttgactgttttcttcatttgaaataactgtgaatgaggctgtttttcccaga

SEQ ID NO: 6445 - DNA, 1527 bp, Homo sapiens
gccactgcgcccggccttactgttttcatatctgccatttctagatctgtttctatagtttgattttctttttttttcttcttctgggtaatgagtcatgttttcctgcttttttttttttttttgacaaaatgcctgtcatttttaagtttgattcagaatattgtgaatttcacattattggttgctggattttgttgtattattttaaatgttttgttggactttgttctggcatcctgtcaaattaacctcgaattatttggatccttttgaggcttgcttttaagtttttgaaaagactttggtagagcaaactttagcctggggctatttattcatactaccgcggtgatacctggagagatctgaatcatcccccgtattacaaggtcatcctactcttgaacaggtagcaatacagagtactcctggccatgtgtgttctttgggaattgttagcctaatgctttcttgtggttctggggttctttctctggccacaggtgctttcttctcatgaatgcacagatcagttttcagccaaaatatgtctgtagatgtagttttaagatcacagatcagttttcagccaaaatacgtcggtagatgtatttttaagatcagagcttttttgtgcagctccatcatcatcagtactctgtttcccaaattctagctgccttgaaagacttgtgtttcctcaactcagtgaaactagtaagtaggctctgttaacctccccttcccccagctacttctaggcctcaagctttggcagccacaggactcacttgatttgtttcccttttgttaggtatacagttctgtgctaccttgtgtgtagagtttgaaaaccattgtttttttgtgtgtgtgtctaattttctagttgttaaaggtgggtgggaggtttaaatctaatttctgttagttgggagtggaagttacctctgctttaatctaaatagttccctagtttttgtttgtcttttatgacttgacattttgaataccactttggagagcatccctcaattcgtgtttgtttgatagttcctcaagattagattgaggtaatgcatttttggcatgaatacctcataagcggtgttgtgtccctcttcgtgcacatcaggaagcacatgatgtctatgttttccattattgtgtgttaacttgtttaaggggatgtctgtcaggtttctccagggtaaagttgctatttttccctctgtatctgtttaagttaagcaaacttttcacccactatttttagcatctgttgtcaattagaaaaaaatccttaaattacaaagttagaataagtctgctaaaagaaaaattgtaaattaaacagtaatagagaaaagtaaaacatgatggtatatacatttttaaaccgttttttctctgcacagacaaatcttgcaatatgaagagatgatttccaggttttattgaataaatgaattgtaatttttacttgaaattatcttatttagtataataaatattacaatatta

SEQ ID NO: 6446 - DNA, 412 bp, Homo sapiens
acaatgcaggccttgtctgctatcaaaaggacactgacttctgtgagtgagatgggataactctgggcaacttttgaagactagactgtatgcaggaaggaaggccaacagttaggatttatatttgtgcttgcctttggatcttcaaaatatcttcctcaaattatttttaacacatgtattaattgtatttaactattcatggaagctcagcaatgccatctagttttcaaattgatccattgtttaaagaatgaggtcaagaattgtcttacactcaaccacgtaatcaataaaccaagagtgttattcataccaagtcacacattgaactttatattaatcaaatcttctctatacatgtggtaattattaagtttagaaattattcattgtcattgtcattattctt

SEQ ID NO: 6447 - DNA, 414 bp, Homo sapiens
agcttataggatggtggactggtaggaactcaagggggagggatcaccagtcaaattctgcaaaaccctttcattactcactcagaaaaggacaacacacacctgccatagaaataacaggcaaggccgggcatgaatgctcacacctgtaatcccagcactttaggtggccgaggtgggtggatcacctgaggtcaggagttcaagaccagcctggccaacatggtgaaaccctgactctactaaaactacaaaaaattagccggccgtgatggtgcacacctgcacctgtaatcccagttgcttgggaggctgaggcaggagaatcgcttgaatgcaggaggtggaggttgcagtgagctgagatcgccccattgtactccaacctgggcagcagggtgaaactccgtctca

SEQ ID NO: 6448 - DNA, 598 bp, Homo sapiens
tctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattat

SEQ ID NO: 6449 - DNA, 841 bp, Homo sapiens
tagaatcctaacaatcctcatgtgggtgcccatgtggttaataacaaaaaccaaatagatagatgtttgggtcacttgaattatttcttgtttaaaaaatatcttttattgattctgagggagttcatgctaatattgggcccgacccttaacactatttgcatatttattagtgaccaacacattttcatgatcatatcttaatagttgtaaacttgcagcaagaaattattcactcacattaagtttcaataaaattttctaactgggtaactgctggtgtaaggtacactatagtgaggatttagtttacatgtatcagataatcatgcaaactttataaattttcaagaaccacaccccaggcctcatttgatatgaagaaaaatgataaaatgctgtatatttttactttaaatataaccaatgtaatgcctgaaatctaaagtcagtaaaattttgaatgacttgacaaaagtaaaaaatgatatataatttcctcacagtttaaagtatgaagcttttggttctagtttctctaattttgttgttaaaggttttctataaacattctgtaagtgaaaatgagagctgcacaccactgtgtccaccgtctttgggagagaagggtgaagttgacctgaaatcagagctgtttttcactcttccattcactcacattgtaaatttggaagaagcacattatctgttgtgaatctcaggttcctcatatgtaaagtggagtggttatctttttgctgcttctactcatgggtatggagtgaagatttaatgcaataatatatgtgaatgaataaagagctttttttggcaaaaaaaa

SEQ ID NO: 6450 - DNA, 460 bp, Homo sapiens
ggttgtcaattttctaaaccttttcctctagattattctggccctaggcctttcagcaaccccactaatcaattattagatcctgccccaaggagcagtggcttgggggctggatttagggaggaaaacctgattaaactgttttgcttagtactggttacagctgtagctggagaagagtttataatcataaagtacatttttgttattaccttgtggattttaattatccatcttgtctaatcttgttctctgtcatcctagataatgaggtgtttgtgggagcagagctctgcacacaccaggggatgtaataaatgtttgcacttggcccagtatattatgaatgtggcacagtaaataaagtttgtgtacaaaatactagtttatttctatgggagccattatgttcaggatatataaaatgtatctaattaaacaattttgaatctaaaatgtg

SEQ ID NO: 6451 - DNA, 886 bp, Homo sapiens
gagatgaggtctcacccagactcgactcgaactcctgggcttaagggttcctcccaccactgagccccgctgagattctcttaatgtgtgctccaacatcttcaagaggaatgaaaaaagatataagtccttcattgcaatagaaagtagatccaataataaaaaaaaatcctaagtatatttgcttttatgaaattgtgattgtctttgttatttttcaagagaagtttatttttagtattaaatcagtccttgaactggtatcaaggaaaaagatatctcacagaagagttttctttctgcaagcaactggcagaaatgtgacatgtttgattatgtatccatttgtattccctatgtattttaatgtttcccaaactgttgttcatcataaaatgaaaaatatgtaaagctctgtttaattatgtctttgcatatccatgtactctttttttttggcaggtggggaaggtagctttaaatactctattaatttgtgtaggctttcttgattttgtcatttaaaaaagatttcatacattgagatagatgtgtattatagacatcatctataggctcttaaaatgaaattgctgtttccacaattaaacaaattccttgcaagattagtcaggaagagaaacggaaatataccaaaatataacaaagtatattttagaaaatatcaaagcactataaataccaccctcttctccatcaggtgcagactgtgattcctccctaaattatagatctgtgagtttgaaagaacagaaggaatttgataacatttcattgcagcaaagtttttgccaaaccgcttttcacagagcccttgtatcttacatctcagtgtttctgaaagagccaaaattagttcttattg

SEQ ID NO: 6452 - DNA, 828 bp, Homo sapiens
gagatgaggtctcacccagactcgactcgaactcctgggcttaagggttcctcccaccactgagccccgctgagattctcttaatgtgtgctccaacatcttcaagaggaatgaaaaaagatataagtccttcattgcaatagaaagtagatccaataataaaaaaaaatcctaagtatatttgcttttatgaaattgtgattgtctttgttatttttcaagagaagtttatttttagtattaaatcagtccttgaactggtatcaaggaaaaagatatctcacagaagagttttctttctgcaagcaactggcagaaatgtgacatgtttgattatgtatccatttgtattccctatgtattttaatgtttcccaaactgttgttcatctttttttttggcaggtggggaaggtagctttaaatactctattaatttgtgtaggctttcttgattttgtcatttaaaaaagatttcatacattgagatagatgtgtattatagacatcatctataggctcttaaaatgaaattgctgtttccacaattaaacaaattccttgcaagattagtcaggaagagaaacggaaatataccaaaatataacaaagtatattttagaaaatatcaaagcactataaataccaccctcttctccatcaggtgcagactgtgattcctccctaaattatagatctgtgagtttgaaagaacagaaggaatttgataacatttcattgcagcaaagtttttgccaaaccgcttttcacagagcccttgtatcttacatctcagtgtttctgaaagagccaaaattagttcttattg

SEQ ID NO: 6453 - DNA, 672 bp, Homo sapiens
ggaaccggctgcgcgggagcgcgcctgagggaggccgcggggggcagggccgggactgcgttgagacagtcgccgtgcctcagtttcctcctctgcgaagggcgggaggagtcggacgcgccctagagccccgcgcgttcctggtgtagcctgctgggcccgtgttctttaagttcctcttcctcggagccgcgcgttcgaccctcgctcccgtttgtccactgatgtcccgtttcgagcccgggagatcctgcatctcggaagccccctgagtcccgaggcaaatcgggaccgtgagcccccctaccctgcagggctccatggggccaaaaaccacgtggtccttctggaagggaactggctaagccaggactgcttttctggagtgataatgtgcttgccttcccgtgtctaaggtcgaccagatggctgtgtgcaccaacctaatagaacatcataagtatcttgagttcaagataaatccataccttacctacactgtctcccaattattatcaattgtcttctgccatctcttaagtcattattatgtcaaataattaaagtcggtgtttcctttagttttgtcactggtgatactactacttgctcttcaaaatgtatctttattcatctaacattttgcaaagtaaagtttcaaagttgttcagc

SEQ ID NO: 6454 - DNA, 588 bp, Homo sapiens
ggaaccggctgcgcgggagcgcgcctgagggaggccgcggggggcagggccgggactgcgttgagacagtcgccgtgcctcagtttcctcctctgcgaagggcgggaggagtcggacgcgccctagagccccgcgcgttcctggtgtagcctgctgggcccgtgttctttaagttcctcttcctcggagccgcgcgttcgaccctcgctcccgtttgtccactgatgtcccgtttcgagcccgggagatcctgcatctcggaagccccctgagtcccgaggcaaatcgggaccgtgagcccccctaccctgcagggctccatggggccaaaaaccacgtggtccttctggaagggaactggctaagccaggactgcttttctggagtgataatgtgcttgcaagagaaaggtgaagaattgggaaacccatgggtgtcacgaagggtggtgagactggggaacgttttagaaaacctggtgagttgcgtcctgcttttgatagatttatctggaggtacctttatggggaacagggatgagaaggaaaagtttcttcctaaggagtacagtttctgtttcacctctta

SEQ ID NO: 6455 - DNA, 382 bp, Homo sapiens
atcatattaggttggtgcaaggtctaccagatgtgtcttgccttcccatgtgtaaggtcaaccagatagctctcacctttccatgtctaaggtcaaccagggggtgcttgccttcccgtgtctaaggtcgaccagatggctgtgtgcaccaacctaatagaacatcataagtatcttgagttcaagataaatccataccttacctacactgtctcccaattattatcaattgtcttctgccatctcttaagtcattattatgtcaaataattaaagtcggtgtttcctttagttttgtcactggtgatactactacttgctcttcaaaatgtatctttattcatctaacattttgcaaagtaaagtttcaaagttgttcagc

SEQ ID NO: 6456 - DNA, 1388 bp, Homo sapiens
ggaaccggctgcgcgggagcgcgcctgagggaggccgcggggggcagggccgggactgcgttgagacagtcgccgtgcctcagtttcctcctctgcgaagggcgggaggagtcggacgcgccctagagccccgcgcgttcctggtgtagcctgctgggcccgtgttctttaagttcctcttcctcggagccgcgcgttcgaccctcgctcccgtttgtccactgatgtcccgtttcgagcccgggagatcctgcatctcggaagccccctgagtcccgaggcaaatcgggaccgtgagcccccctaccctgcagggctccatggggccaaaaaccacgtggtccttctggaagggaactggctaagccaggactgcttttctggagtgataatgtgcttgctaccctggctgataaatgggacttggattttaaataccattggataataaatgtatgtgatggctttggagcaaattgattgacaatggctaggagacagcttcccaaggctggaaagaggggagtgcggaacatgcctccaccataccactgcccacctcctgtgacctctgcagcaaaacctgaagccccaaagaggcagcttctcaaagtaaaagtggaatgaagttcctggtgacctgaattcccatggaggaaagaggaaaaggacattatgcaaggagatggcatctcgtgtccctggtgaaccaaattccattaggaagacggtgcagtgtgaggtggacctggacctggataaaatgggtgtttaacaagtatttgttgagtaggtggtggaggaggcacgactagatgcagggtctagctgagttgacaagagctaacaccaggtgtggaccaggacagggggaccttaagcgaagacaccctgccagatgtgtcttgttcccttgactgtggggaggcccttggtggtggggtgacggtcccccagtctgaggattttccctggatgtagcctctcagtgctaaaatgggacagtcccaggcaaaccaggtcagttggtcactctactcagtgagccccgtgctgtgttcaaattttcctcttaacagatgtggatggatttcggaaacttagaaaccaccatttctctgtgcctgggaggagagttaaatcttctcaccagaatccttttatgtgtgagagaaataaatatctatcctttttatatctcttttgttttggattctttgtcaccagcagccaaacccaattcttacataaacgtgatactaattaaattcatttgcataaactcaccagttttatccttaattactgtgatatacactcatgaagtatgtaccctaaaataccactgtaagttttatttgattacagcattaaacttaatttacaga

SEQ ID NO: 6457 - DNA, 1039 bp, Homo sapiens
acagaatctcactctgtagtcacccaggctggaatgcagtggtgcgatcttggctcactgcaacctccacctcccagatgcaagcgattcttgtgcctcagcctcccgagtagctgggattaaaggcatgcgccaccacgcccaggagacagcttcccaaggctggaaagaggggagtgcggaacatgcctccaccataccactgcccacctcctgtgacctctgcagcaaaacctgaagccccaaagaggcagcttctcaaagtaaaagtggaatgaagttcctggtgacctgaattcccatggaggaaagaggaaaaggacattatgcaaggagatggcatctcgtgtccctggtgaaccaaattccattaggaagacggtgcagtgtgaggtggacctggacctggataaaatgggtgtttaacaagtatttgttgagtaggtggtggaggaggcacgactagatgcagggtctagctgagttgacaagagctaacaccaggtgtggaccaggacagggggaccttaagcgaagacaccctgccagatgtgtcttgttcccttgactgtggggaggcccttggtggtggggtgacggtcccccagtctgaggattttccctggatgtagcctctcagtgctaaaatgggacagtcccaggcaaaccaggtcagttggtcactctactcagtgagccccgtgctgtgttcaaattttcctcttaacagatgtggatggatttcggaaacttagaaaccaccatttctctgtgcctgggaggagagttaaatcttctcaccagaatccttttatgtgtgagagaaataaatatctatcctttttatatctcttttgttttggattctttgtcaccagcagccaaacccaattcttacataaacgtgatactaattaaattcatttgcataaactcaccagttttatccttaattactgtgatatacactcatgaagtatgtaccctaaaataccactgtaagttttatttgattacagcattaaacttaatttacaga

SEQ ID NO: 6458 - DNA, 442 bp, Homo sapiens
acacactaaattaaatggtaataatttctatggagaaaaataaagcaggaaagtccttgtgcgatggtgacatttgagccatgacctcaaggaaataacagtgagccatgaaaaaatctgaaggaagaactgcactctaggcagaaaaaattgacaagcgcaaagaggtcttggtggtgcatgcctggtgtgtctgtctggaaagcaacagggatgcatgtggctggagcacagtaaatcaggtaggagtataggaggagaagcggtcttagagagaacatgctaccagattatttggggcccacaggctattgtaatgactctggcttttacagaaaaagatgggaaaccagtgggagctttgagtatccaggggtgtgatctgtattttgacaggctcactctggctgctgttgagaacagactgaaggaagccaaggac

SEQ ID NO: 6459 - DNA, 343 bp, Homo sapiens
caaaggtctattgataggaagctgagatagggaaaatgaaagtgttctgaaggtctcttgatactggaaagggtgaaacgttagaagaaaaagttacttgattgggaaaatgttacctcttggtaggagtataattgatatcttactttaaataataatggaaactgttgtctaaaatatgttcaagcaatgtgtccaaccagaaaagagcgaggtaaacattaaagaaaatggaaaaaggggtggtaaacgttaacagaatagaaaagtatattacaatttcaaattaacaatgagaagaaatggaaggactatcaacatggccaaaccattaaaaatgaag

SEQ ID NO: 6460 - DNA, 549 bp, Homo sapiens
ataccttgggagatcgattctctagtaatatgtatttggttgttgttcaacctcagtgagacacagagactgagatgggtcccagaaggagtagggaagagggactgaagagggtctgagtgagggatggaggtggttgttggcatttatttaggagcattgcagagttgccttttaaagatctctttaaagacaatagaaaggagtagagaccgatccctttataacgtgggggtttagcattatctcatttttgatatgcagaaggatatctcattattgtgttggatgccccttaaatgcttcaaactttcttcctgaatgtacccagggcaattttgggggtgttaatgtggcctcgcaggcaaagggagatgaacaggatgacctcttgcgaggtagtcctagcatctctaaccctacggttgtcaagtctctgacaccattctgcttctgacgtgtctcttaaacttcaagtgacctatatttaggagattacgtaaaaagtattgaaagcaaatggccattctgctctaaggtcagagttct

SEQ ID NO: 6461 - DNA, 515 bp, Homo sapiens
ccctgctgattgtcatcgttttaattatctgttaacatatactcatcacctccccctgacaggcctgttaattgttctggtagaggagtgaggccaccaagtgcagtcccacagaacgatgtgattggtgaggggttaggacactgaacatcttctctgtcctgagcaaatgccatccatttaacccatttgtcagtttggggaagtgattctgacaggtcacctttcataatggctgcacttctatttatagaaccagctgatgattgcacatggtcaactcggattcttcttaccctgagtgaatttataatgtcgctgcagcgtactgtttatccccacagtgagaagtggcgtgctctctcagtcccttcatcttcctattttcaggagctggtgggcaccagccaggaactggctctcaccttctggcatttactgtgagccggcctaacaggtgtgggcctggcctggctccacagaggcagtgcccctcagcagactcagactctgtc

SEQ ID NO: 6462 - DNA, 427 bp, Homo sapiens
aaattttcagaatgcaatacaatattattaactatagtcctcatgctgtgcattagattcctagaactatttatccaacagagctgcaactttgtaccctttgacctatttatgtcaatttaaaagtagaggagataactaaattttattaagcactgtctagtgaagctttatgctacatgcatatgttatcttattcagttttcccaactgcattgccttgtcatgtacataatgtataccactttttggattagaaaattggtatagagaaaatgttaagtaacatatccaactgacaaaaatccaagagttaattagtagaagaataacatatcaaccccagtcatctgagatccaaaatccaaatcatgtctttttatagggtgtccaactgactgggataccatttactacactgtcttca

SEQ ID NO: 6463 - DNA, 447 bp, Homo sapiens
aacatacactgaaggccagaagtgaactgtcaattatataaaaatgttttggaaaggttaaaaataactgtgaaagccaagagagtcttttgttgatttcaggtgtttcaacagtgcctacggattttacagatgtcacgttccctgtcatccgcatgctctttagatcagtggttctttaactgcgatgcccttaacagcctcgtggggatcctttaaaactccctatgtccagtctagcctcaaacaattaaatcagactctaggattggaccaggcagccagactattttcatcctgattgtgcacagctgggagcctctgctttctgtgggatgtgtaagctcacattgtgtaatgtcatatgaggagtacacttaataacaaaggttttttgtttgtttgtttgtttgttttgagatggagtcttgctctgtctcccaggct

SEQ ID NO: 6464 - DNA, 275 bp, Homo sapiens
aaacggcaacagcaagaagtggtagctactacaagcttgaaaaagggaaggaggccaggcatggtggctcacgcttaaaatcctaagctttaggaggctgaggcaggcagattgcttgagcccaggagctcgagaccagtctgggcaacatggtgaaactccatctctacaaaaaatgcaaaaattggctgggcccaggaggctgaggcaggggcatcgattgagtctgggaggtcgaggctgcagtgagccatgatcacaccagtgaaccccag

SEQ ID NO: 6465 - DNA, 455 bp, Homo sapiens
atggcattcttattcactatgggtagtataaatttagtatggcatagtacagtaagtagtatgacagtttccagtaaattttaggcattcacataatgcagtcagaagaaagtccacattaagataaatacactatagaaatttaggcacaatgcttatagcagcataaatatttagcaaaaactcaaatgtccatgaatgaatgaatgcatgcattaaatgtaatagaagatggaactattacatcagatcttcatttgtatcagcaatttaatgccttaatatgctattgagtgaaaacaattacagaaagataaattcagtaagatagaaaatcgcagcctggcatggtggctcatgcctgtaattgcagcacttttggagttgaaggtgggagtattgcttgagctccaggagtttgagaccagcctaggcaacatagtgagaccctgttt

SEQ ID NO: 6466 - DNA, 442 bp, Homo sapiens
tgagacagagtctcactctgttgcccaggctggagtacagtggcttgatctcagctcactgaaagctctgcctcccgggttcatgccattctcctacctcagcctcccaagtagctgtgactacaggcatccgccaccacgcccagctaattttttgtatttttagtagagatggggtttcaccatgttagccaagatggtctcaatctcctgaccttgtgatcagcctgcctcagcctcccaaagtgctgaaattacaggcatgagccaccgctctgggctgtgttctgccttttataatattcccctcataaagaatctcactactttgccttcacctgggaaaataaacaatacacctggactgttatgccccaacgatttactaaggccctacatatttctcatgaacctatttgatggagttaaaattcccagaaga

SEQ ID NO: 6467 - DNA, 340 bp, Homo sapiens
ggtggcatgcacctgtagttccatctgcttgggagtctgaggcaggagaattgctggaggtggaggttggagtgtgctgtgatcgcaccactgtactctaggctgggcgacagaggaagaccctgtctccagtcaatcaatcagtcaatcagtcaatcaatgtaagggtcttaaaccatccccaaagcaaaggagtctatgtttatgtcccgggcatcttaaccctccaattcaatcagtgtttattaagcatcttatagagctaagaattttgaaggttgactttaatagctttacctgtggagagtctcatggcagggaacatgagaggtgctggcgt

SEQ ID NO: 6468 - DNA, 498 bp, Homo sapiens
cggtaagtgaaataagccagtcacaaaaaggccaatactgaatgattccacttatgtgaggtatctagagtagtcatattcatagagacagaaaatagaatgattgttgccagcaactgggaggaagggggtgtgaaaagttgtttaatggatattgagtttgttttcccagacgaagaagttctgaaggttggttacatgatgtgaatatactaaacactactgaactgtgtacttagaatggttaagataaattttatgcgttttcactacaataacaagtagaacagtagaacagatgattagtcacagcagaaaagatgaaagataggtcaaaacaggttattagaaaatatccaaactgaagatgaagaagaaaatcatttttagtagaaaatatccaaactgatatataaagacataaaggaatttgtggaggcagaggggagataaggcaataaaggacatgtgggacacatccaaaaaaaaaaaaaatcc

SEQ ID NO: 6469 - DNA, 477 bp, Homo sapiens
tgcaccaagaaaactttatttacaaaagtaggtggcaggctggatttggcccctgggcccttagtttaccagcccctagtctacagcctccataaaattctccaatggtcaatgagctggaaggacttaaccactatgcctttatagaaaaacatgcagggaggttactcccaggccctcatcttctacgaaatgtctgctctttgtgaatgaggacgtaggacagtggccagactgcatgtgaattatctaacagagccggtggctctgggagagcgagggcatcaacagctcctcagcagtcctgggcccatggtgctgacaacatgtggcaggcaaccaaccaagcaggtccttcataaaaggaaaactcaggccgggcgcggtggctcatgcctgtaatcccagcactttgggaggctgaggcgggcggatcacctgaggtcaggagttcgagaccagcctggccaacatggt

SEQ ID NO: 6470 - DNA, 535 bp, Homo sapiens
tagaatcttcccagcctccctcatcctcccgagtctccctggggggcatttaacacactggactctaattgaggggtcctttctctccagatcctgagctctttgagggcagggacttcctcatccttgtgtccccaggacctggcacattgggtgctcatccaatgttaacagaacctaaacagaaaccatcaacagattcaaaaaggacatccaggcaccgtacgttagggcgtcgagcctactggttcactctcgtacctctgtactccaggaggtattctgagtgtcgcagaatcacatctactgtcagggagctgcagtcaaaggaaaccaaggactggaaggaagagttgcactgaggaggggcagagtcagctccttaacctccctaaggcttctcacagtgagccctctagaaaggtttatttatttatcttttacttttactttttgatttgtattatttatttatttatttatttgagatcacgctactgcattgcagcctgggcgacagagcaagacatcatct

SEQ ID NO: 6471 - DNA, 336 bp, Homo sapiens
atttgacagtttggatcacactgtcatactgtcaccaagaactcaaaccaatgcccagtgctcttaggtactggcttgctgtaaaagacatatcttgagaggccgaggcaggcggatcgcaaggtcaggagttcaagaccagcctgatcaacatggtgaaaccccgtctctactaaatatacaaaaattagctgggcatggtggcacgcacctgtaatcccagctactcaggaggctgatgcaggagaatcaccggaacccaggaggcggaagttgcagtgagccaagattacgccactgcactccagccaggggacagagcaagactctgtcaca

SEQ ID NO: 6472 - DNA, 417 bp, Homo sapiens
aaacaagaaggtggtgctcaatatatattggttgatttgactgttctatgctagataaagccaatgcaaaatcgtgtatatgtaacacaaccgtgccaactatcaagtgtccattatgtgctaggcatattgtcttcaaagctcatggcctctctgtaaagtaaattatatcaaccttttttattagatgaaaaaactctggggctcagagagtttaaacggttgaaggaggtcaaacagtaagtagcagagattgggacctaattaacataggttggaaaacactttggaaaggttgatttaaatgatttgtacaatgtcaaccctgggtgaatttaaagagcatgggctatgtcttgctcaaggcgcaacttcttccctcaattcatgctaccttttggcttttcttaaaaaaaa

SEQ ID NO: 6473 - DNA, 449 bp, Homo sapiens
aattctgcctcagcctcccaagtagctgggactacagatgcacactgctacacacggctaatttcttttgtattttagtagagatggtgtttcaccttgttgctcagtctggtcttgaactcctgagctcaggcaatctgcccatctccgcctcccaatgtgctaggattacaggcatgagccaccgttcccggccaaatataaattttaaattagtaagtgtctaattagggttatattactgtatgtcagagccttgtagttttctatttgaacacaaaaatgtacaatttaattcttatactctttccaaggaattaagttactagaaataacttgctttaaaattctttcacttataacgtggttccatggcatgaatcactaagggtacatacttattcttattcacaaaatttccctctatggcttttctaaagtatgatagc

SEQ ID NO: 6474 - DNA, 327 bp, Homo sapiens
ggagaataaaagtaagcatttgttctctcctcagctgactttgaggtaaacaaaaatgcttttagaatcccagaatcaatcaaactataaaacataattacagtatataattcagtgtacaacatataattcaattgaagtaaaagaaaaccgagattttcctatctggaagtctgatttgctttataccagaagcgctctactcccgcgggctgaatggcctaaggaggccctgtggagacccccatcttctaccacccgctcccccgagcccagtgttcttcttccccccaggctctcactcatagatgagctctctgagctccc

SEQ ID NO: 6475 - DNA, 379 bp, Homo sapiens
aaagcaggaaacaaattatgtacaccttattacaattgtttcatattaaaaacaaatgcattagtgaaagattagaagggaatataccagactactgtaacagagattttgttagggtactacatactttctcttttaatttttctataatgtggttatattgtttttataatgaaaaagacacagggttaaaaaggaaatttcagtgtctgacatgcttggagaagattctagagcacttctagatttctagaagtacttggacctgagatttcgtctgccaagccaagtactagcattcagttctataaagcaagtaacagtatcctttacttcactcttaacagtttctttttgaaaaaacagactccaatgtaaa

SEQ ID NO: 6476 - DNA, 457 bp, Homo sapiens
attcgcggccgcgtcgacccactcactgcctgacttcctgttctgcgcatgggctcccaggaagttaatatacactatggacaggtagcaagttatggacagatagcaagatagccagttaatatactctatggatgacccagcaagtttgctgtttcagaatcctcctcttctgttttttgaactttcgaaaacaaaagatgtgctgggagacgcggcccctagagtgtgcttactccaggtccttgattgtccagactgtggagggggaagggcagatctatgccaagaggggaacaggctgtagaggccacagctgattcatttttgtgaccttagcactctgcccagcacctggaatatagtaggtgctccataaacctgtgttcaaggagagaatctgtccatagcatatgtattaatgggacctttatagtcaatggacatccttagaaat

SEQ ID NO: 6477 - DNA, 623 bp, Homo sapiens
agaattgatggaagccatgatcatcagattcaggaaaaatggcaagttccacacaagatagacacagataaagaaaaacctagacatagtgaaactgcagagaaccaaagaaactaacttgcaaaaacaactggagacaatagattattgacaaaaatcactgggtggattagctaatgcctataatcccagcactttgggaggccaaagtggaaggatagcttaaggccaggagttagagaccagcctgggcaacataacgagatgctgtctttaccaaaaataaatcatttctttttaatattgttggatttgctttgctaatattttatggagaatttatgtgtctaagttcatgaaagatattggcctgtacttttttttggttttgactggtttggttatttggcaatagcaacctcataaaatgagttgaagtgttctctcaccttctgtattctggaatattatataacattggtgttaattcttctttaaatatttggtagaattcaccagtgaaaccatctgggcctggagatttattttatgaatctttaaaattatgcatgtaattgttaatgatgataaaactattcagattttctgttttatcttgtgtt

SEQ ID NO: 6478 - DNA, 413 bp, Homo sapiens
tagaaatggggtctccctgtgttccccaggctgatctagaactcctgggctgaagcagtcctcccacctcagcttcccaaagtgctggtattacaggcatgagccactgtgcctggcaaccctatcctttctctctgttttacaaataatccgcaaaacaaccatcatcataaaattgtcctccttttatactctggaagataagtcaggagaattgtgttgttcaaggccagcctgggcaatacagcaagacccccatctctttaaaaaaaaaaattgtgctcctttccacctatgattttttttaatttttaattattatttgtttttaaattttttttagagatgaggtctcactctatcacccagattagagtgcagtgctgcagtcgtagctcactgcagcctcaaac

SEQ ID NO: 6479 - DNA, 645 bp, Homo sapiens
ctgtgctttccaatttgccccagtctccactgctccctattgctctttggctctgagtcactgtttgtcatcacgctggtcccgttgttcttcttacagaggtaagaggagagtgagatatgtcttactcctcttgttacttgtccctgagagcattgaatttgcaacctttagataagatggcatgtatcttccccagggcctcacgggcatcccaaaactcaacaggtcccaaaacaaacccctggtttcacccatagtctctgcccccccatcacaagtttccccatcttagtaaatggcagcccccaggaatcccagaacttcaccccaaacctgggggctctctttgactcctgtctttcaccagctcccctcgcccccattcgatccagcaaaagatcctgccagctttactttcaaaatataattaaaaggttgggagcgtggctgcccttgggggaggggcagtgatttggagggggcttctggggacttctagggggatggacaagttctatttcttgagcttgatgctggttatgtgggtggattgggtttgtaaaacttcatgaaactgcaggcatgtttatatgtgtacttttcagtatttatgttgtacttcaataaaaagctgtgaggcca

SEQ ID NO: 6480 - DNA, 372 bp, Homo sapiens
ttgagacagagtctcactctgtcacccagactggagtacagtggcttgatcttggctcactgcaacctccgccacccggattcaagtgattctcccgcctcagcctcccaagtagctgggattacaagtgtgagccaccacgcctggctaatttttatattgttagtacagatagggtttcaccatgttggccaggctgatctcgaactcctgacctcaagtgatccacctgccttggtctcccaaagtactgggattacaggtgtgagtcaccacacctggccatttttgaactttaaataagtggaacctacatatctatctatctatctatctatctatctatctatctatctatccgtctctctgtct

SEQ ID NO: 6481 - DNA, 400 bp, Homo sapiens
tgcatagttgattttaatctagatgattaaaaggataagtgctggtttttaaagcactgatttggataaataacatcatcactcttggagagaagtagagaagagccatcctgcaaagtaggagcaattctctgtgcttctcctttcattccgcccactgcagagggggccaggcagaggcagaaactgggaaggaggtagccttttcaggaaggcagatttaaagggctgaatttaaatacatcaatgattgaaaagaccctatcccaaattttttattattattattattattattattattatttgaaacagagtcttgctctgttgtccaggctggatgagctgagatggcgccattgctctcccagcctgggtgacaagagcaaaactccgtctc

SEQ ID NO: 6482 - DNA, 362 bp, Homo sapiens
aaaaaaatttaaaaaaataaaaatcctgctgggcaaatatatgcagggttctttgggctgggacttgagacccacccagcatctgtggcattcctgcatggcttgtgccaataatatgtggcaggggcattacagaatcagtgtataaaggaaattgtgtgctcatttggagttcgcttgtcaatgtcagtgatgactatcacttgatcttagccaaaagactgaaaagcaataatgatgactatcactattcagagctgtgctgcccaatacgtagccattcatgaattcaaattcaaattcaaatttaattacaattaaataaaattttaaattcatctttctcagctggattctgagaa

SEQ ID NO: 6483 - DNA, 342 bp, Homo sapiens
tcattaagagtgggggagggtggagagatgaatcaacggcaaagaggtaaccctgcagctcccactctccactgagctctgaccttaaagttcggtcaggttccttaaggaaaagaatgtatcgccctccccccacctctcccagctggggcctctcgaacaacctcccctcccccaaactcagcagaaattgtatggggaaggaaacgccagcagctgggcagggaaaagttgccgctccctaaacttgctgatgaattagtagaggcttcagctgtttcaggatgtgtcttctggtcccccaagcccgacatgggtgcttgagctcacagttcacctgga

SEQ ID NO: 6484 - DNA, 87 bp, Homo sapiens
tgctgccattattaaactttttccagaactatgggattatgtgattattttgatttttaaaaaactagaataaaatattgatatacc

SEQ ID NO: 6485 - DNA, 379 bp, Homo sapiens
ctaaattttgttcatttaagtttgttctttctgctgggatcccgggggaactttcccttataataaaagctgaaggatgtccagattatgctcttctcctccatctgcctgttaagtccttaatctcctacacctgggtgttctaatcctttatttgctttaagtaccaagtggttccaagtcggacaagttctgtgtccaatatgccaagtaagattcattgtgccatagaagggcatgctactccccaagatctcctggagaataaagtgggttgctgttcacaaatggacctgctggttttaatgcagcccagttaataaatggcattcactcagcatacagccaagagtactccattgattggcagcaggaagct

SEQ ID NO: 6486 - DNA, 308 bp, Homo sapiens
tctttctgtgctggagaaacacgatctgtctgtcacagaaagcttgggtaattgttaaaccagtgtttagctacataccttgatttgtttggggcctaggatccccctggaaaagagcttcaacgctgaaaaccaactggaattcagacatctaaggtcatgtgttaaagactgtgaggatgggggtttgtggggctgcagaaaggaaagctagactgtaaagggcaacaacaggttccctgagagaaaagtccccacaagggagaatattggcctcgtggaaatctagaccagcaacttcaatagaa

SEQ ID NO: 6487 - DNA, 1376 bp, Homo sapiens
ttcactctggagaaaggccacatgagtgtggagaatgtggaaagtgttttcgtcaaaagggaaacctcattaaacatcaacgagttcacacgggagaaagacatcatgaatgttgaaaatttggcagatctgttggtaaaaagagcaccctcattcaacattcgtgagatcacactggaaagcacttatgagtatggagaatgtgcaaaatcatctagccaaaaggttggcctcattcaacaatagcaagatcacactggggaaaggctttctgagtgtagagaatgtatgaaatcctgtacatagaagttttgcctcaccaaataccagaagggtcacactggagaaagaccctatagttatggggaatttgggaaattacctaacaagaagtcccacctcactgaacactactgagttcacagttgagaaaggccatatgactgtaaggaatttgtaaaattatttagccagaagagctgcattactattcatcagataatttacaatggagaaaggccacataataatttctcacataataaatgtgagaaatcatttccgtacagctctgcgctccatgttcgtaagagttcacactggacaaagccttatgagagcagcgagtagaaaatcctttgtgggaaaactctggtttcattaaacacaggagagttcatgctagagaaaggcctcaacagtgtagcaaatatggaaagacattcactagaagctctgccctgcaagttcacactagagaaagcccttctcagtgaagtaaatttggaaaattgattagtcaaacctctatgctccttcaaaatcagagttcacactggatcaaggctttatggtgtgacaaatatggcacattctttatctaaatgtctaacatattatgcacagacaagctcctgctgtggaagtgccttttgagtgcagagcatttgcgagggcttcactcttctttcactggataccagaatgttgacaggagaaaaataacatagatgtgtgggaatattacttcttgtccagtgtaactgtgggagagagcccttatgaggacaccatcaacctatattgaatgtcatatgtccagtagctgcataaattccaggtatatgggagctgtattgcatttcttatcctgcgtatgtccttgccagatttatttcattcttaggtctctggcaaaagccatttcatctctaccacttggcaggtacctacagtgcatcactcatgcactccatcatattccagaaaaaaagttcaagttgtctcccattcagcagtggtatttttgagtagcctctgcactcgttcctttctcatttctctatgaagagttaggccatggacctgactcagtt

SEQ ID NO: 6488 - DNA, 1440 bp, Homo sapiens
  misc_feature (407)..(407): n is a, c, g, or t
ttcactctggagaaaggccacatgagtgtggagaatgtggaaagtgttttcgtcaaaagggaaacctcattaaacatcaacgagttcacacgggagaaagacatcatgaatgttgaaaatttggcagatctgttggtaaaaagagcaccctcattcaacattcgtgagatcacactggaaagcacttatgagtatggagaatgtgcaaaatcatctagtgccaagaagcgttgtgctctcacttgcgaaccaataggcagagatccacacgtggcgcgaaatggctattactgatgcttgtagaagaactgctcatgacaactccgtagtagccatagtaatgtcttgtgcgctcgaccagagatatccatgagagtggtccacgactcgtacgatatagaaccatnaatagttattgggggaacttgtgaggaacattaccttaatcccgagaaagtcccacctcactgaacactactgagttcacagttgagaaaggccatatgactgtaaggaatttgtaaaattatttagccagaagagctgcattactattcatcagataatttacaatggagaaaggccacataataatttctcacataataaatgtgagaaatcatttccgtacagctctgcgctccatgttcgtaagagttcacactggacaaagccttatgagagcagcgagtagaaaatcctttgtgggaaaactctggtttcattaaacacaggagagttcatgctagagaaaggcctcaacagtgtagcaaatatggaaagacattcactagaagctctgccctgcaagttcacactagagaaagcccttctcagtgaagtaaatttggaaaattgattagtcaaacctctatgctccttcaaaatcagagttcacactggatcaaggctttatggtgtgacaaatatggcacattctttatctaaatgtctaacatattatgcacagacaagctcctgctgtggaagtgccttttgagtgcagagcatttgcgagggcttcactcttctttcactggataccagaatgttgacaggagaaaaataacatagatgtgtgggaatattacttcttgtccagtgtaactgtgggagagagcccttatgaggacaccatcaacctatattgaatgtcatatgtccagtagctgcataaattccaggtatatgggagctgtattgcatttcttatcctgcgtatgtccttgccagatttatttcattcttaggtctctggcaaaagccatttcatctctaccacttggcaggtacctacagtgcatcactcatgcactccatcatattccagaaaaaaagttcaagttgtctcccattcagcagtggtatttttgagtagcctctgcactcgttcctttctcatttctctatgaagagttaggccatggacctgactcagtt

SEQ ID NO: 6489 - DNA, 1148 bp, Homo sapiens
gaaagcagagcagagacagtcaagtgttagttatacttcagtggaagtctcaatacaggtacatgcgtgcgcacacccacaaagcacatcaagaaaggggacccaggagttccccaccaacaaaaagattttgtttctcccatcagcttttattctgctgaaagtcattagagactattgaaattttttatttttaattatatctcaaagtggattgatactgcagttggtgaagtagattccacagtaaatatgtgagtaggtgtttcagaagtactgactttgattttttggtagcatttgagataatacaggttttactctacttctaaaaatattttatttaaaagaaaaatgaaatgaaggtttatataaaaaggcatcacagttttggactgttttactctgatatttagaattgtttcagatggattttttagatctgatatgttttactggtgtagaatattggcaggctgtatgaagaaaacgtggaagagattttggctttccttctctctgtgcctatctcctattatatttcttctcactccctttttaggtttgttaactaaccataatatggaatacatattgttatttctcacatttctagaatacatctttgtgatctgcatttattttatattcaattctgattactatattctgtattatagctgcttaaagatgtactccaatcttatttccatttttaaatgactataattttagcttatgtttatcacttttttcagttcaattaagaaaaaagtttctgcccatatgtatgtactacctgaagctttcataaaatgagcacttgagacactgtgtaaaatgtatagaatcctggccaggcatggtaactgacacctgtaatctcagcattttgggatgccaagttgggaggatcacttaaggcctggagttcgagactagcttgggcaacatagtgagacctcatctctaaaaaattattttttaattaggcaagtgtcgtggtacacacctgtatttctagctacttgggaggctgaggcaggaggatcacttgagcccaggagttcaaagttacagtgagttattattgtaccaatgtactcctgcgtgggcaacagattgagaccctgtgtctttaaaaaaaa

SEQ ID NO: 6490 - DNA, 465 bp, Homo sapiens
tggctcacgcctgtaatcccagcactttgggaggccaaggcgggtttattaaaatatattttttggctaagagcaaaaacctcattgtttaatgaggttttcaatgtatgcagaagtaataaaagacaagtaggatgtaaagggagaagaataaagtgacctaaaatggtggtaagattcctcctacattccagctgaggtggtaaaatattgattctaagtatactgtggaaagttaaggatgtacactgtcatctctaaaaaaataaaattaaactatacaaagatgcagagtcaaaatcacaataaattaaaatggaagactaaaaaatgttcaaataacccaaaaagcagaagaaaaagtttcccttgaaaatcacaaaatgctaaaactcacccaagataagaaagataacctgaatagtcctgtaattgtttaagaaattgaatttgtggtttaaaatc

SEQ ID NO: 6491 - DNA, 360 bp, Homo sapiens
agagagagagaaacctaagatatctttgagatttgtcctatgtaactacatggatgatggtatattttcctgagataataaattttgaaggtagagtaggtgtgggggtgttgagttcaattgtgatgaatgataactgcaaggtgcatgagtgacttttcagctgctgtggagagtgtgctactgggcatagggccctggagcttagcagggatgtgggtatgtgtttatagatgaatttatagatgatagttacatgtttgcagatgaaactgcctaggcagtgtggacaagaagaaaaggcaaagggtagagccttgaggtacaccaacattcatggagggcacactagagaatcct

SEQ ID NO: 6492 - DNA, 363 bp, Homo sapiens
atttgacaggaacatgcaggtacctcagtggcccaattttgagaaatagagggaattttttcatcgtaaggatggtagattaggtcctaggtgagtaatgaaaagaaggctgaaaaacaaaattccttattagaaccagaagtgttaacctgacaaacacattcattcaaactctttagcacgtgaaatatatatatgaaatacatatggtactcattttcccttaaaatgagccatgattgaaaaaagaaacaattttacattctcaaggttggaaatagaggaagatatgcattggcgataatattgatttaaaaaaaaatctgctgaaaggctattattagacatagattatagttacag

SEQ ID NO: 6493 - DNA, 372 bp, Homo sapiens
ttgcagtgagccgagattgtgccactgccctccagcctggcaacaagagtaagactccatctcaaaatagtaataataataataataatacccatcatataaggttgctgtgggaattaaatgactctgtacagagaacacatagtgcatggtttcatacatagcaagaatacctgaagatcccaaggaaatgtcaattccacggccacctctgggtgctcaagggctgagcaccttcaccagcagggcaagcctggtccctttcctctcctataaccttccttttgatcacactacacctcaatcagctattccaaggggcaaacatgcttctctagagtgcaacacgcttagaggcaggttcttagagag

SEQ ID NO: 6494 - DNA, 456 bp, Homo sapiens
tacagaatgaagtagtgactttctggaaaggaattggggccactggaaagggtatgggttccacatactaccagatctaatgattctattaatagtctatcagtgaggattcattcatttgcataccgcctccttcctgaagggatttaaggcatctttctaaaagcaaaatgcagcttggcacagtggcccacgcctgtaatcccagcactttgggaggccgaggtgggcagatcccaaggtcaagagatcgagaccatcctggccaacatggtgaaaccctgtctctactaaaaatacaaaaattagcagctgggtgtggtggtgcacacctgtagccccagctacttgggaggctgaggcaggagaatcgcttgaacctgggaagcagaggttgcagtgagctgagatcgcgccactgcactccagtctggtgacagagcgagactctgtctc

SEQ ID NO: 6495 - DNA, 973 bp, Homo sapiens
gagccaaagccttcactggggcccagggtgtcatctatgcaggtttcccctggaggttctaactggggggtttagagcaagcaggcatgagccccggggactcacgctgtgactgagaggggtcggtgtgggtaggatatcggcatggtccatgtgggtgtgggggtcagtgggacaagtcaagcaggtggtatccagctgtccatgggaaggtggtcccaggaggcggttttgtaaggcagatgtctggatcgaccaccttggggaacagtgagaagttgtataactggaaactgtgttactaatccctgcttctagtatgagaaagtccaacttacattcaaatagatgctcaggaaacataaaattcaaagaattcccaaacttgagcttcctgagcctcagtttttgcatctgtcaaatgggtatggggagaccctttgcctaatgttgagagaatccaagcctgagcagggctggtctactgtggacacttagttgtggaccccaacaggccaaagcccttgcctgctgagggctgctcccaggaggcctcacacattcatccggcctcccaggaaacccctgagatgtgctgggcttttgccgtggaacggtgtcggtgagcatgtggccagtagccagagtcttcaacataggtgggaggtctgaaattcgtgcgagaatgaaccaagggtgtggctgtatccttcatggtgagcttggggcctgggcagccttccctctgctgagtcctttggtcaaatgtcatggtgttctgaaccagcactgcagatagaagtataatgtaagtcacacacgtacttctttaaaaagatatgttcttcagtgactattagacaaacagataaatgaaggtaaagggaaaaaatggcaactttagcttttttccccatgtatgtaattttaaattttcttatagccccattaaaaaaaggaaagagacacaagt

SEQ ID NO: 6496 - DNA, 402 bp, Homo sapiens
cctatatctgtgagctggggcaggggagagtggagggtctggactggcccaatttaacttcatttaccacactttaagaaatcttccccaggctgggagcagtggttcacacttgtaatcccagcactttggaaggtcaaggtgggaggatcacttgagcccaggagtttgaaaccagcctgggcagcatagtgagaccctgtctctaccaaaaaaaaaaaaaaaaaactgggtatggtggcacatggctgtggtcccagatacttggaaggactgcttaaacccacaaggtcatggttgcagtgagctgtgatcatgccactacactccagcctgggtgacagtcagacctgtctcaaagaaaaaaaagtcgaccggccgcgaatttagtagtagtagtag

SEQ ID NO: 6497 - DNA, 1483 bp, Homo sapiens
aagaaccttcagagaaacccaccctctgacaggctctgcccatgcccacaaagatctgagctgcttggctggttgtttttgtaacaggcatgctctgttgctattttttaatgacaggaggaacttggtgtacctggcactttgggctgcacagacgcattagcagactcaccttgtcctgtttcatccctcgccctccacaatttcttattttctttctttctctttttattttttgagacagagtttcactcttgttacccaggctggagtgcaatgatgcgatcttggttcaccgaaacctccgcctcccgggttcaagcgattctcctgctgcagcctctcggtagctgggattacaggcatgtgccaccatgcccggctaattgtttttgtatttttagtagagacggggtttctccatgttggtcaggctggtctggaactcctgacctcaggtgatccacctgcctcggcctcccaaagtgccgggattacaggtatgagccactgcgcccagcccacaatatcttattttcatgtttttttgtgtgttttgttttatttttcgagatggagtctctctgttgcccaagctggagtgcaatggcgcgatcttggctcacttcctgggttcaagcgattctcctgccttagcctcccaagtaactgggattgcaggcacccaccatcatgccctgctaaattttgtacttttgtagagatggagtttcaccatgttggtcaggctggtcttgaactgctgacctcaggtgatctgcccaccttggcctcccaaagtgctgggattacaggtgtgagccaccatgcctggactcgttgttgttgttgtttttaattagtgaggagctacaagaacacatttataaaaattaagaggaaacagccccactgcatttgagaaggttaccatttccttcgaagttcctgctgttgccccttcctggtgggggagacactgtcctgtttcagtcattccgttgctttgctttatagttttattaatgtgtttgtgttggctttgcatgttttcaaatatatgaatgaaatcatgcagagtttattcttttacagtttgccttttcacttgattatgttcctgagatgtatccggattattgtgtgtagctgtatggcattccttttccctgctgcctagtgatccattgaaaatacaataattgatttttctatgtggttccactggtcatttttctgcccctgtgccctttgggaatcatctcctaaactctagtctcggcccttgctcttccatgtaaccttgagaatcagcttgtcaaattccccccaaaaaccccttgagatgtagaatggaacccagctgaatctatagatcagtctggataaaatcagcacctgtgtaaaattgaattttcccattcatgagcagggtttatttctgcactcaatgttttcaataaagttgtgtaccttttcccat

SEQ ID NO: 6498 - DNA, 692 bp, Homo sapiens
agtagagacgaggtttcaccgtgttagccaggatggtctcgatctcctgaccttgtgatccacctgcctcggcctcccaaagtgctgggattacaggtgtgagccaccactcctggccggccagcatggtcttgatctactgacctcgtgatctgcccgccttggcctcccaaagtgctgggattacaggtgtgagccaccgtgcccggccgcctggctgacattttcaaagatggaaagtggatggagaattaagagctgaaattatgtgttcccaaaaggtggggccaaaaggcaagtggaattacctgccagagccccggaggggctcaggaactccacaatttcttattttctttctttctctttttattttttgagacagagtttcactcttgttacccaggctggagtgcaatgatgcgatcttggttcaccgaaacctccgcctcccgggttcaagcgattctcctgctgcagcctctcggtagctgggattacaggcatgtgccaccatgcccatctctactaaaaatacaaaagaattagccaggcgtggtggtgcatgcctgtggtgccagctacttggggggctgaggtgaaaggatctcttgagctcggtgagttgaggctgcagtgagctatgatcatgcccctgtattccagcctgggaacagagtgagaacctgtca

SEQ ID NO: 6499 - DNA, 660 bp, Homo sapiens
agtagagacgaggtttcaccgtgttagccaggatggtctcgatctcctgaccttgtgatccacctgcctcggcctcccaaagtgctgggattacaggtgtgagccaccactcctggccggccagcatggtcttgatctactgacctcgtgatctgcccgccttggcctcccaaagtgctgggattacaggtgtgagccaccgtgcccggccgcctggctgacattttcaaagatggaaagtggatggagaattaagagctgaaattatgtgttcccaaaaggtggggccaaaaggcaagtggaattacctgccagagccccggaggggctcaggaactccaccaggaccatggagggtgaggtgaggcttcggccaacaatggggaccgatggaaagtctatgtaaggatcagtggggtgccgctcccccacatcccacccacaccccacccacatcatgcagccagcagctacacctctgggtggggtggtgtgacgtgaggattatttgaaggataaatggaaccagagaagcttcgggtcttaggcgtactggggagggtattattaattttatggtttaattgggagttttgaattttttatatatttttatatatatttaaatgttttaggaattatttttgtttttaataattt

SEQ ID NO: 6500 - DNA, 623 bp, Homo sapiens
agtagagacgaggtttcaccgtgttagccaggatggtctcgatctcctgaccttgtgatccacctgcctcggcctcccaaagtgctgggattacaggtgtgagccaccactcctggccggccagcatggtcttgatctactgacctcgtgatctgcccgccttggcctcccaaagtgctgggattacaggtgtgagccaccgtgcccggccgcctggctgacattttcaaagatggaaagtggatggagaattaagagctgaaattatgtgttcccaaaaggtggggccaaaaggcaagtggaattacctgccagagccccggaggggctcaggaactccaccaggaccatggagggtgaggtgaggcttcggccaacaatggggaccgatggaaagtctatgtaaggatcagtggggtgccgctcccccacatcccacccacaccccacccacatcatgcagccagcagctacacctctgggtggggtggtgtgacgtgaggattatttgaaggataaatggaaccagagaagcttcgggtcttaggcgtactggggaggggtgggtgagaggctagaccaaaaaatggggttaagtgaaagtccatagatactgctggggg

SEQ ID NO: 6501 - DNA, 1624 bp, Homo sapiens
agtagagacgaggtttcaccgtgttagccaggatggtctcgatctcctgaccttgtgatccacctgcctcggcctcccaaagtgctgggattacaggtgtgagccaccactcctggccggccagcatggtcttgatctactgacctcgtgatctgcccgccttggcctcccaaagtgctgggattacaggtgtgagccaccgtgcccggccgcctggctgacattttcaaagatggaaagtggatggagaattaagagctgaaattatgtgttcccaaaaggtggggccaaaaggcaagtggaattacctgccagagccccggaggggctcaggaactccacaatttcttattttctttctttctctttttattttttgagacagagtttcactcttgttacccaggctggagtgcaatgatgcgatcttggttcaccgaaacctccgcctcccgggttcaagcgattctcctgctgcagcctctcggtagctgggattacaggcatgtgccaccatgcccggctaattgtttttgtatttttagtagagacggggtttctccatgttggtcaggctggtctggaactcctgacctcaggtgatccacctgcctcggcctcccaaagtgccgggattacaggtatgagccactgcgcccagcccacaatatcttattttcatgtttttttgtgtgttttgttttatttttcgagatggagtctctctgttgcccaagctggagtgcaatggcgcgatcttggctcacttcctgggttcaagcgattctcctgccttagcctcccaagtaactgggattgcaggcacccaccatcatgccctgctaaattttgtacttttgtagagatggagtttcaccatgttggtcaggctggtcttgaactgctgacctcaggtgatctgcccaccttggcctcccaaagtgctgggattacaggtgtgagccaccatgcctggactcgttgttgttgttgtttttaattagtgaggagctacaagaacacatttataaaaattaagaggaaacagccccactgcatttgagaaggttaccatttccttcgaagttcctgctgttgccccttcctggtgggggagacactgtcctgtttcagtcattccgttgctttgctttatagttttattaatgtgtttgtgttggctttgcatgttttcaaatatatgaatgaaatcatgcagagtttattcttttacagtttgccttttcacttgattatgttcctgagatgtatccggattattgtgtgtagctgtatggcattccttttccctgctgcctagtgatccattgaaaatacaataattgatttttctatgtggttccactggtcatttttctgcccctgtgccctttgggaatcatctcctaaactctagtctcggcccttgctcttccatgtaaccttgagaatcagcttgtcaaattccccccaaaaaccccttgagatgtagaatggaacccagctgaatctatagatcagtctggataaaatcagcacctgtgtaaaattgaattttcccattcatgagcagggtttatttctgcactcaatgttttcaataaagttgtgtaccttttcccat

SEQ ID NO: 6502 - DNA, 279 bp, Homo sapiens
  misc_feature (3)..(3): n is a, c, g, or t
cancctccactccacctcccttcctcctgcgatcgtccacaccacctccatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaa

SEQ ID NO: 6503 - DNA, 3797 bp, Homo sapiens
gagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataaaaaaaaaaaagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaa

SEQ ID NO: 6504 - DNA, 1641 bp, Homo sapiens
ggcaggacgaggccggggtgaatcggccgagggcctgtttgactgtcagatacaaaatctaatcccgtgtcttgtatctgacaagtcaaacagagcaaggaagtactactagtggactcaagtgatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataaaaaaaaaaaagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaa

SEQ ID NO: 6505 - DNA, 2433 bp, Homo sapiens
gagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaatta

SEQ ID NO: 6506 - DNA, 4230 bp, Homo sapiens
  misc_feature (4128)..(4128): n is a, c, g, or t
gagccagcctctgggaccgaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataaaaaaaaaaaagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaacaaaaagagaagctcatttatactgtcaccagtggcgcacataaacactagtgcctggtgcttattgatatcattgtaggtcttttttttttcccttgaatcaatcacatcaaggaaagaatgatggaaagcatttgctggtagaaatagagacttcagggcctttgtcagcctgaagacatgtcccactgcatcgaatgctgtgacctggtacacaaagctcaagattcccacacgaccaagaagtgtcaccaaggagtccctgtgagtagtaccgaatcttgccatgtgctttttacaggtctgcgttggatgtgtttgtggctaacanttttttccttctgtggtatttaggggcagagagagaatgatcttaacatctcgatcagatgatagatgaattggcagatttagatatgtgatttatacttta

SEQ ID NO: 6507 - DNA, 314 bp, Homo sapiens
atgtccttgacttccctgaaatggttgttatgattaatatctcttgttctgcttgtgttccatagtggactataattattatgatctttttaaatcgtttgcccattctgaatctctcccttttcttatggcaaaagttcagagtctaagtttataaggaatcaatggacagactttagaagctccttgaactctgtacttttgttttaaattttgtgtttggacttaaaaaaaaaaactggtaaaaggatatgttggtttcctcaaatttctcccaaaataaaaatcccttttaaaagaggattaaagaatta

SEQ ID NO: 6508 - DNA, 420 bp, Homo sapiens
tatacacacaatgaaataaaaagatctgataacatagttgttcacaatatagcaggtgaaaggaaaaaaggacagttgccaaaaaagcacagtaatgactaaaaattactaagaacataaaaattaagtcacacacaaatgtacacaccccaaagtgtatgcctcgcttggaaaggaatcatagatgcttttatgatcttcttttttgctcatctgtgtgaggatctcattacttctactgccgctgctaactcattcagggattgtctcagtttccttggataataaggggcttcactgcatttaaggcttcctgatttattcaaacagtaactacacaaatgcacgcacacatacacacacacacacacacacacagtctcctatatgttgctatgcagagatctctagacacattta

SEQ ID NO: 6509 - DNA, 390 bp, Homo sapiens
gatcacttgaggccaggagtcctgagcaggcatggtgaaactccgtctctactaaaaatacaaaaattagccgggtatggtggggcatgcttgtaatcccagcgactcagaaggccgaggcacgagaattaattgaacccgggaggcagaggttgcagtctgatgagattgtgccactgaacaccagcctgggtgacagagtgagactctatctcaaacccctgtacccccatcccccccaaaaaaacccattccaaatcttttcatctcctctctctgtggagtgctctctgttgctcagcgctccatgcccattgctgtggagctgacctggggagtgactgatggctcctgaggctgaaggatgggaaatagcaggagggctcctgg

SEQ ID NO: 6510 - DNA, 618 bp, Homo sapiens
atatctagctgttactaagctgcccttcccataacggtctgccccaaaaaggtgtgtgtgcagaggagaataaaaactaaaaccctaagatcatcttatttacttgccctatttctgcctcttttctctccctgccatctctggggtccagaagtagaagctttttattgcctccggagtttattcttatacatcaaggataaacattcatgacctaacatcatctctcttgttttctcccgccaaagctataaggatagtctaatcatgaaaaaacattaaacaaactcaaaatggggacagtctataaaatacctaaccagttctcttcagaacagttaaggtcctgaaaggcgaggagagaagaagaaacaatcacaacttggaggacattaatgcactaaatttaatatggtttcataagttgggctgaaaagaaaaggacagtagaaaagctgggatatgagaatacagtctaagtgtagtactaatgttaagtttttaatctctaacttgatggcatggttatagaaaatagaaacattaggcaaagctgggtgaaaggtatacaggaactctactatctatacaacttttctgtaaacataaaattatttc

SEQ ID NO: 6511 - DNA, 672 bp, Homo sapiens
ttgtttcatcacactgaatcgttggccaagaaatgcttgaaaatcaaaacattaatatcatctttcttcttttttttaaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6512 - DNA, 2676 bp, Homo sapiens
  misc_feature (701)..(701): n is a, c, g, or t
gaaaggaacatgtagagggttttgatatctaaaccctacccagttttctgtaggatcttgattttattttaatgcaagactgctgaccccatgatcctgtgtgttcttcagagatactcttactgatgatgtataaatgaactttgattcagtaaggtcagtttgtaggtctcaaagtactttggttattgtggtacatcagaatgatagctagtatttactgagatctttctatatgtcaggtaataaaaatcctataaaagtattctttctacagccacaggaggtaggtactatttttattttacagatgaagaactgtggattttgtttctaagaaaatttccaggctcacagaactaagcctaatttctttttattttttagcaaatacagtttttataagaatttgaattctatgaaaataaatggattactcctaaatctctgatgcctcagtgaacactttttccttattaacaaaattctcacttttggctttggattggctttgcaggagtgcagattgatcatagcttttttcatgtcctaagagttgtcagagttttctcttgtagcatttttttctttactttttttttttactatctttaaatatatgactgtaagagtatgataaatatgctgttttctaatctctgctgttgtcacataaactaatatattttgagtaattttgnaatgatattaataatgtcattagattttctttggattttttgaaaaaaataatggttttagaaggaaatctggataaattttatctctgtcctgtgtcagaaaaatataaaacttgagttttttaaattaaggtactaagatgaataaattgcatctatagatattgaaatatgactgtaatttgataatgcattttcattctcagtgtcattgttcatcataatagtatctacatcaccaacttcatttagagcttgaatcttgtaacaatagagattgaaaataaattggtttataattaactctgacagagaatgatgtttttacttttatacttctctatagaagtacatgtcccttaattttaaggaatgaacaagtcagatggaagatttttactgagatcaggaatgaattgagtaatttagttttctttttaaagctggggagaaatgagcaaaatcaaggagaaatatcttgcttttgatatttattactgatgctgtgacactccctttaatcaatgttttttaatatgggtggcagtatctcagttaaccaaatagttaagtaagtagatttttgtattgtatatagtaaacagtatcctaattgttgccaaggagacaaggaattacctaatgggcaaaaatgcccttatatttatttacctcaaattcagtcacacttgactgtatctccacaaattcagatggagagctggaaaatttatagagaagaccagggtttaaatcttgttttttcaaattatgtttggtcatgatgaatctgaatcatttatttaatgataaaatcatctgacttctcacttctcacttctcccttcagttaaaattatttaagtaatggatttgtttttctatgagagacatttggtattttggtaatgaaagtgtattattttagttgcatataatttgaaaacagcattttatggcaaatctatcaagccaggcagatactttgcatttttgatcttttttttttttttttttggtggctacatcttttctgtattctcagatatgtcgttaaagatggtgccacctatagtggccattttcgttatctaaacaaaaccaacatctgttggattgaaaaactatgctatgatcgactgctttatgtgtgtatgttttttttttttttcaaatcccttaagattcttttctataattagttttctttgaagaagcttggaaagttttctgcattgagatttagaatccacagtgtttctgtaatttagctttccaggaattttgaattttaatttttgtttttactttttatgtacacagtataatgatgttagtgttaaatattaaaaatctgactcttcactgggacttttttatagatacaaatgtatctgtggtagtacaaggactttgttactttggcgtgcagtcttatcaaggagttgtgtgtgtgttttgcatacaactttacaatttcatagttgaaagctgttacaaaatgaaagttttgtgtatggtaggatatcttcaaggtgggtggatgttttctgtttaaaagattaagatgccaacagcgtttttttcttttaattttttcatcaagcaccacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6513 - DNA, 491 bp, Homo sapiens
gtgtatcttaaccatcttttataccatttccttgcagcagccagttaaagtaacacaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6514 - DNA, 789 bp, Homo sapiens
atctcggaagaagctcggaacctgtactggcattgaaattgataatccacgttgtctctgtaaatccagctcaccacgaatgctgaatttcatctccaagtaaaaactgcccgatgtacaccgaataattcgagtgattagattctagaattattatacaagtctgtactcttcgctgtggacttaatcaggattgatacaaatgtatctgtggtagtacaaggactttgttactttggcgtgcagtcttatcaaggagttgtgtgtgtgttttgcatacaactttacaatttcatagttgaaagctgttacaaaatgaaagttttgtgtatggtaggatatcttcaaggtgggtggatgttttctgtttaaaagattaagatgccaacagcgtttttttcttttaattttttcatcaagcaccacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6515 - DNA, 492 bp, Homo sapiens
  misc_feature (54)..(54): n is a, c, g, or t
  misc_feature (56)..(56): n is a, c, g, or t
aaaattgtaaataactcattacttatcaaagaggaagaaagagtttataagatncncaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6516 - DNA, 489 bp, Homo sapiens
cccaccacccaagctcatttttgatcggcagtaagaatgaacaagaaaattttgaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6517 - DNA, 491 bp, Homo sapiens
atttattttttaatacttacaatataaaaaaacaacaaaaaaggctatagttgcacaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6518 - DNA, 477 bp, Homo sapiens
gcggatgtagtcaggacgtgtagaggagcgcgacgggggcttaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6519 - DNA, 422 bp, Homo sapiens
tagtgtgtttataagtcagagggggtggaaggggggtgtgggcttgctcccacacacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6520 - DNA, 388 bp, Homo sapiens
  misc_feature (4)..(5): n is a, c, g, or t
  misc_feature (12)..(12): n is a, c, g, or t
gagnnggaatancggcgactagcacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6521 - DNA, 1071 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6522 - DNA, 2396 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6523 - DNA, 1265 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggttctccaacggaggagctttttaacctctttccggtgaggtgggaactcatcttcatgatcgaatttaaaagaacaatggaaccctgactacgtttcaacaaaaataaaacttgtttttttccctcctattgggtgttggcttttaactctttcaaagccgattttgaaacggctgcagtgatacatgcgaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6524 - DNA, 1141 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggttctccaacggaggagctttttaacctctttccgccgattttgaaacggctgcagtgatacatgcgaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6525 - DNA, 806 bp, Homo sapiens
  misc_feature (34)..(34): n is a, c, g, or t
acggcagcgctgcagcgcaggcgactctagaggncccccccactctcctcttgccggtgaggtgggaactcatcttcatgatcgaatttaaaagaacaatggaaccctgactacgtttcaacaaaaataaaacttgtttttttccctcctattgggtgttggcttttaactctttcaaagccgattttgaaacggctgcagtgatacatgcgaaggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6526 - DNA, 1277 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaaaaaaaaaaaaaacaacaaaacaaacaacaaaaaaaacacccgggggcaccttaagtcggggggggggaaaaaaggggtctcagaaaggggcccgtgggccatgggtgtttcccggaccccctttttgggcccaagggggaaaactgggggggcccccaaaaagggggcggaataaattcggaaaagcccggggtaaccggataagg

SEQ ID NO: 6527 - DNA, 1560 bp, Homo sapiens
cggtgatccgtaacagaagggggttaaattttccccctagggagcctagaacttccccccgtggggtaaattatgaaaggtgaccgaatttcaacacgggccaaaaaaagtttacacattttggtttagaaaaagtttttttttttttttgtggggatagtatggaaaagggattcagaagtgatgaaaaaggtatgttacttgagatatgggaaacgctattttccatgtttagttatggggtattcaagtctaactagtggaaagtatggatacattttatttattttttgagacggagtctcgctctgttgctcaggctagagtgcagcgatgcgatctcagctcactgcaacttctgcctcctgggttcaagcaatttctggctaatttttgtatttttagtagagacggggtttgaccatgttggccaggctggtctcaaacacctgacctcaagtgatctgcctgcctccacctccccaagtgctgggattataggtgtaagccaccgggcctggccggatacatttttattatcaagtatatattttaggaatgattagtgttggtttagttgaatagattggtacaattagtagtaatttgaaatgatgcctatggtttcctaacattttgtcttagtgttgattaaagacataataatgtgaaataatatggtaatactaaggaatgagaaagtggccttacaggtgggcaatgtaaactttcctgtagaaggattgaaagtaaatagatgtaagactagaaagtgaaacaattctgtactgtaagagcaatgttggctgtgttaaataactcgttcccaaacatcagatccacctggggagcccaaatatttacctacatttttggagttcttaggggctgaaacttacgcttgtgattttgtagtaacctattctagagaggagccaaatttgtgatactcaagagcttgtatgatttctgcttggactgtattgttaatacatacatacatcttttggtctattggcaaatgacccttgcaagatgttgacattttgggtataaatcatggtgcttaataatctgttttcattttttatgtataaaattaaattctttttgtcctctgcagaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6528 - DNA, 543 bp, Homo sapiens
tcatatacgactcgattcggtagtatgccattttgaagactgagacgttggagttttatcctagaggataaaggaaatctttgggaaagtcagtattttatatagcaaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6529 - DNA, 4001 bp, Homo sapiens
  misc_feature (701)..(701): n is a, c, g, or t
gaaaggaacatgtagagggttttgatatctaaaccctacccagttttctgtaggatcttgattttattttaatgcaagactgctgaccccatgatcctgtgtgttcttcagagatactcttactgatgatgtataaatgaactttgattcagtaaggtcagtttgtaggtctcaaagtactttggttattgtggtacatcagaatgatagctagtatttactgagatctttctatatgtcaggtaataaaaatcctataaaagtattctttctacagccacaggaggtaggtactatttttattttacagatgaagaactgtggattttgtttctaagaaaatttccaggctcacagaactaagcctaatttctttttattttttagcaaatacagtttttataagaatttgaattctatgaaaataaatggattactcctaaatctctgatgcctcagtgaacactttttccttattaacaaaattctcacttttggctttggattggctttgcaggagtgcagattgatcatagcttttttcatgtcctaagagttgtcagagttttctcttgtagcatttttttctttactttttttttttactatctttaaatatatgactgtaagagtatgataaatatgctgttttctaatctctgctgttgtcacataaactaatatattttgagtaattttgnaatgatattaataatgtcattagattttctttggattttttgaaaaaaataatggttttagaaggaaatctggataaattttatctctgtcctgtgtcagaaaaatataaaacttgagttttttaaattaaggtactaagatgaataaattgcatctatagatattgaaatatgactgtaatttgataatgcattttcattctcagtgtcattgttcatcataatagtatctacatcaccaacttcatttagagcttgaatcttgtaacaatagagattgaaaataaattggtttataattaactctgacagagaatgatgtttttacttttatacttctctatagaagtacatgtcccttaattttaaggaatgaacaagtcagatggaagatttttactgagatcaggaatgaattgagtaatttagttttctttttaaagctggggagaaatgagcaaaatcaaggagaaatatcttgcttttgatatttattactgatgctgtgacactccctttaatcaatgttttttaatatgggtggcagtatctcagttaaccaaatagttaagtaagtagatttttgtattgtatatagtaaacagtatcctaattgttgccaaggagacaaggaattacctaatgggcaaaaatgcccttatatttatttacctcaaattcagtcacacttgactgtatctccacaaattcagatggagagctggaaaatttatagagaagaccagggtttaaatcttgttttttcaaattatgtttggtcatgatgaatctgaatcatttatttaatgataaaatcatctgacttctcacttctcacttctcccttcagttaaaattatttaagtaatggatttgtttttctatgagagacatttggtattttggtaatgaaagtgtattattttagttgcatataatttgaaaacagcattttatggcaaatctatcaagccaggcagatactttgcatttttgatcttttttttttttttttttggtggctacatcttttctgtattctcagatatgtcgttaaagatggtgccacctatagtggccattttcgttatctaaacaaaaccaacatctgttggattgaaaaactatgctatgatcgactgctttatgtgtgtatgttttttttttttttcaaatcccttaagattcttttctataattagttttctttgaagaagcttggaaagttttctgcattgagatttagaatccacagtgtttctgtaatttagctttccaggaattttgaattttaatttttgtttttactttttatgtacacagtataatgatgttagtgttaaatattaaaaatctgactcttcactgggacttttttatagatacaaatgtatctgtggtagtacaaggactttgttactttggcgtgcagtcttatcaaggagttgtgtgtgtgttttgcatacaactttacaatttcatagttgaaagctgttacaaaatgaaagttttgtgtatggtaggatatcttcaaggtgggtggatgttttctgtttaaaagattaagatgccaacagcgtttttttcttttaattttttcatcaagcaccacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6530 - DNA, 1518 bp, Homo sapiens
aatattagtgccatagagaaacagaaattggtgtatattttgaacagagatgctgcagcccgacttaccatttcatctcccctggaagcccacaaagcaaacactttagtgtatcatgtagttggagtagatgtcggatttgaagatccaatgtttgcttgtctggaaatggattatgaggaagcagacaatgatccaacaggggaagcagcagctaatacccagcagacacttgactgtatctccacaaattcagatggagagctggaaaatttatagagaagaccagggtttaaatcttgttttttcaaattatgtttggtcatgatgaatctgaatcatttatttaatgataaaatcatctgacttctcacttctcacttctcccttcagttaaaattatttaagtaatggatttgtttttctatgagagacatttggtattttggtaatgaaagtgtattattttagttgcatataatttgaaaacagcattttatggcaaatctatcaagccaggcagatactttgcatttttgatcttttttttttttttttttggtggctacatcttttctgtattctcagatatgtcgttaaagatggtgccacctatagtggccattttcgttatctaaacaaaaccaacatctgttggattgaaaaactatgctatgatcgactgctttatgtgtgtatgttttttttttttttcaaatcccttaagattcttttctataattagttttctttgaagaagcttggaaagttttctgcattgagatttagaatccacagtgtttctgtaatttagctttccaggaattttgaattttaatttttgtttttactttttatgtacacagtataatgatgttagtgttaaatattaaaaatctgactcttcactgggacttttttatagatacaaatgtatctgtggtagtacaaggactttgttactttggcgtgcagtcttatcaaggagttgtgtgtgtgttttgcatacaactttacaatttcatagttgaaagctgttacaaaatgaaagttttgtgtatggtaggatatcttcaaggtgggtggatgttttctgtttaaaagattaagatgccaacagcgtttttttcttttaattttttcatcaagcaccacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6531 - DNA, 994 bp, Homo sapiens
atataagataaatatagtggatcatgtagatatgatattaaagtactatattttataaggaaggtggattattgtatatttaccactgttttctgcttaagaaccaaggtgatacttatataattgtttttaccctagcattttgggataattcttgagtcataaaaatctcctgatcaacttggtgattgaattggattgcattagttctgatagaaactgtttaaaaaattacctgacattctatagaaatgaaaggagccatgctgtgtaatcacaaggctttcatgacatgacatttatagattatatgaaataggtaatttcaaatgtaaattttaagttttatttactattagtcatcgttttttgattatttaaaaatttgtactatggacaactaattaattttactttttatcctctgagatttgattgtggagcggcataagggggagaaagataagttgaggacgtctctttatcttttgttaatcagaggtggtgatagagtggaaaatataacacgtttcggcattcaggagacctaccttccaataaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6532 - DNA, 506 bp, Homo sapiens
  misc_feature (39)..(39): n is a, c, g, or t
tgtatgttgtgttgctactctcgcgttattttcaacagncaagaaaacaaatgccttattagtaaaacaacaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6533 - DNA, 486 bp, Homo sapiens
agtgatagattatttaactttgaaacataagaaagaggctcatagtaacacaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6534 - DNA, 490 bp, Homo sapiens
ggggagtgaaagttctgagatgacaatatctatatcacgaacgagggagctcaggaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6535 - DNA, 495 bp, Homo sapiens
aggcagtctccctccttcaggattggggagatcctgggaaagtattatgtttatatagcaaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6536 - DNA, 479 bp, Homo sapiens
accaagtgcgttaatgaggtcgagtcagaaggaggcggggacttaaatatgaacctcaaactgaatcctctaaaggccccatacaatgaagtagacattggtggaaacatttacacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaa

SEQ ID NO: 6537 - DNA, 2246 bp, Homo sapiens
agctcctgccgccgccgcagccgctgccgccgcagcgaagaggccatgttgtgtggtgtgtggggcggggggaggaggaggagggagtaaagcctagagaggagacgggagagagacaccacacacacggcacaagatggccggagaggcagcagcaccccgagctgtcaggcgttccgccgcggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgacttaagagattaaaattaatttggttgctgttggttctgaacaaataatgagttcttttatttgaggtatgccattttgaagactgagacgttggagttttatcctagaggataaaggaaatctttgggaaagtcagtattttatatagcaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6538 - DNA, 1764 bp, Homo sapiens
gttctacctactagccccatcgcctataccaagttgacataaggagcacttacagcccacacagcttgcaactcacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6539 - DNA, 1751 bp, Homo sapiens
tgttaattcgtatagcgaacggggcgatacgttatgaacttcaattggaattgacagccccacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6540 - DNA, 1711 bp, Homo sapiens
gtgactctacaggatcccggcacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6541 - DNA, 1714 bp, Homo sapiens
agtccggggtggggaaacaaaagcacccagtcagcttgaagagtttcaaatggaccctaccactgagaaatcaagatggcagtctactatggggaattgaggaaaaatggattaatacaagagtcctgtgataatatacaaccaagacagggttcttttaacatggattccatgcagtgaatgaagacataggtttcttacccaacacaaatggacagtggatttgactttctaaagactttttttgtggacattttgacatttggagaagaaagatggcacactaacccagataatagtttttatgcctggaattttttgcagtttgatttgtatgcgtatgacctcttgaaatgttaatttttaataaaatttgtaacacttaaaaatttctcagtttgggtttttttttttaagtggaagtttaattaaatgtttagttttattttagtaatactttggcctttgtagttgccgagtggtaaagtgtactgaatatgaataaagctggtaaattggaaatggtgtaatcgaaaacattttacttggtttatgaagatttacgtttttcacaaagttgtgctcttagatggtcatttggtttaaatactgttttgtttgtgctttcatgaaacacctttcaaaacaactcaatgggtaataatagaatctgattttaatctgccacaagattttaatgaacttgaaacaaactgcttgttgctcgaaaattcaggatgagtgatacacatatacttctgaattattttgtgttgattgaaatggtttcttaagctttttaatactataaatacatcttgctatagaatattcatctgaatatttaaattaatgtctcctattgtcttactattagaggaagaagtgttggatttatgggttagggtccttggagtattcacaattttttaaatttgaaattatgtgtgtaatccattttatataactttgaagtaggattaatatcttgtatcgtctttattttgtacaattggggatttagaataaatgaattgcaccctgccatagattacttacgtttgatttttaaatgccaggttttcatttattactaatcaactgataccagttttggtaactattacaaaggtggtaggcattattttggtagacaaaatgagttcttgattctgttttcccattttacatgagaagaataaatagttcaggttaaattgttttgtgttaatcatactgtttgtgattcatgtcaaatactgcagcatacacatccatggttaatacacgagcaccatttgttattgactgatgtgaggtggttggtctttgttaaattcaaaaatggaattttggatattgttcttgctacgaaatttatctttgtgtgtagagtatggaattgaaacagtttggattatggattttacctagattggacattgttgcttttgtttggtgtaaatctaaagtggatttcttcagtgagggagagacatggttctggcagattatgttgaataaggaaagttgattggatttttttgggtgtgtgaatatgcttgtctgaatggagtgcttggtaggatattgtttctggaattagtaatttgtttctgtggatctcatggttttgatatttaggagaatttgctttgtgacattactttgataatttgcaatcacgtatgtcctattgttaataacattgttg

SEQ ID NO: 6542 - DNA, 385 bp, Homo sapiens
cggccgcgaggcccgccggccggcggggagctacgcccggacggccagcaggcccgcgggagtggggctgccgcggctgaggcgaggcgggccgcgcgcgtcggcgtcacagcccgcggcagaggcgcccagggcggccgggcccacgacgccgaaagcgccgctgcggttgccgcctcggaggctcccccgggccccggcggctggacccggcgcgggcgggaggctcgggcgggcggtccggcccgggactcgggtttgggcgaccaggaggtgccggtggccgcgctcggacccggtgagtggctccctagctccttttattgtcctttgtccttgggaggaaaagcaaaatgtccttgagcgcgcgagcaggagggggcgg

SEQ ID NO: 6543 - DNA, 411 bp, Homo sapiens
  misc_feature (364)..(365): n is a, c, g, or t
  misc_feature (402)..(403): n is a, c, g, or t
catataattggcataattgaaaatgtctgaccatagggcactactgtttatctgtagctgaatttctatttagtggtttctcatttttacccacataattagtggcatgacttagaaggcctcccacattatttcctagttacatcgccagagttcatcactgaaaccttgtctccaaagaggtgggcacctaattatgtcctgcagagctgttgatacagaactgtaatgaaaactaatgaaattgattaacccagactatatttgatgaaggagttaaatacagtatgacactgtgagccctctttcttttttttgagacggagtctcactctgtcacccaggttggagtgcagtgagccgnngaaccgccattgcgctccagcttgggcaacagagcgnnattcgtca

SEQ ID NO: 6544 - DNA, 403 bp, Homo sapiens
tcttatgggaccgtctttgtgtatggagtctgttgttaagtgattaacatcactgcgacacatgactgtatttctgtgggttttggcaaatgcagtcatggctctaccactagtcacaagtcggaacacttccattaccttatatgctgtgttttggaagaaattattaaaagtagtttgatacttaaaattcaaagaaaaatcgttttgtggattttactggtattttagcctagtttaagtgagaaatgtgtttctcccttaaggcagttgggatactaagaataggcgagatttcagttcttattttcactatgatttgatatttattgttattccagaacatggatttgtgtttccagcttttaaataattgatatttttcatataatagattgagact

SEQ ID NO: 6545 - DNA, 226 bp, Homo sapiens
aaggatttgaaattgaccctcaaagaactgaatatctttttaaataaaatgacaatattaaaaccacatgcttaaaatacgtacggctaagtgcttcagcagagactgggataccagatcctgagttcctcaaaggcaggagtgtccaagtcattcacttttgcttcaccggagcctaacacattgcctggagcagtgttggtactcaggaaaaccttctgtcgaa

SEQ ID NO: 6546 - DNA, 369 bp, Homo sapiens
gtgacttcagtggtccaagggtgaaacgctggtggctgggaccagagtggaggctgaggagtgggggagaagtggctgaattcagattttgagctctcagccttctggaagggacattaggaggaaggaggatgggcagccctgaagaggggagaggggtcaagtgctgtggctcacacctgtaatcccaggactttgggaggccgaggcgggcggatcacctgaggtcaggagttcgagatcagcctggacaacatgttgaaaccctgtctctactaaaaatacaaaaattagccagcgtggtggtacacgcctgtagtcccagctatttgggaggctgagacaggagaatcgcttgaacctgggggg

SEQ ID NO: 6547 - DNA, 548 bp, Homo sapiens
tctgctcactgcggtcagctgaacaaatgtgctgacatttcactcctcagcaggctatgaaactcttcacttgtgcccaagttcttgttaggtagcaaggctacctaggcctgttccaataatgagaatctgttctgcttgagcccacggaacacagctccactctctgctgccacttggccatctccagtgcttggcccaatgtgacccttctgcttgggccattctcatgggcagccaggtacaaattctggtctctgcctcactggcttctctgaatttaggctggcccccgagtctgcctgcagctctcctgcagcctggctactcacaaaggtcagtcccttccttgcgagggggtctgagtgtcctccccaacttggaaggaggggctcatagactgtttccctgggctggcagaaaggcaattaaagcattgtttgctagctgtgcggtttgcacacctcttctccaagaggaaacaaatattttgaggagatgacttcacagggaaggcacgttgctcgggaggtctgttttccagactc

SEQ ID NO: 6548 - DNA, 501 bp, Homo sapiens
ggggaggggcggggcggggaggggccaggcgggagcgcagagcacgttcgcgggagggtctggccttgtcatgcgcggggtcgccgcgggaaggaggatggcccgttgagggcttggcacggatacctgacggtcggaggaaggggggagagccggtaaaggaggctgacccaaaactgaggcccggtgcatcatccctcatgagaggcaagcccagaagcgccacaatactagggtcccccttcaggagacagagacccccaggacacagagggcccccaagtcactcagcccccccaggacacgcagctcctgcaggacgcagagggtgcccaagacacacagtccccaggacagagaccccccaggacacagaggacccccaagacacgcagtctccaggacacagaggtccccccaggacacacagtgcccccaggacacagaggtcccccaggacacagcactcccaggacacacagcccccccgggacacagaaa

SEQ ID NO: 6549 - DNA, 263 bp, Homo sapiens
gtttgggctgactaaacttttaaacccaagaatttctccctttatttgctttatggctgaattatgaggacagatgcaccttctctcttagcaaagagaaaaaccaaaatctttttacttacacatgacccatattataaacagcttctcatgccctgttcaacatttctatatctctgtcccccaaaagcaaacaaaaagttccaattgccagaaccattgctactgccactttaggagatgttattaagaaacaaggaaaa

SEQ ID NO: 6550 - DNA, 573 bp, Homo sapiens
gtagagtcagtttcccctctatcttgttaccccataattcctgtggaaagtttcccatgaacttgaattctgccttctaactattgtcaccatttggagatttcctattatatgttgtgtcacaactgctggagatctaccttttcactttttcatctcttcttcgtttagcctgcttcgtaatttgtaacctcccaccatctcttagaatgcacgggcagtccttatttctggcatacatcaagaaaggaatcagagcctgattgctttgaaaatgccaggattctacggccaggctcacacctgtaatcccaacactttgggaggctgaaatgggaggactgcttgagcctgggagtttgagaccagcctgtgcatatagtaagacctcgtctctacaaaagatttctttaaaaaattgccaagcatggtggcacaaacctttggtcccagctactcaggaggcttaagtgggagggtcgcttgaacctggacggcgaagagtttgcagtgagccataatggtgccactgcactccagcatgggcgacagagtgagaccttgtctgaaaaa

SEQ ID NO: 6551 - DNA, 436 bp, Homo sapiens
gcatctggagagggagaattgtaaatacttgaaaggaagccatagctttggacttccctgattgtagtgactcttataactgtcccttgtggaaattctagaagttctgcctatggagttgctactagagatactggctcctgtggtacatggggccttctgccctagggtgattctcattcatatccagtgtgaatcttctccctgtacctgatctgtgtcgactcctgtaaggactcccactgaagaggaacacctgatacttctttgttggcaatctgtgttttcctaacagataccgttttgagtaaactggcaccatgtatggcctatggctatggttgtcttataagtctggatgtttagttgagccttaagaagactttctgggccaggcccggtggctcacgtctgtaatcccagcactttgggagac

SEQ ID NO: 6552 - DNA, 424 bp, Homo sapiens
aaaatattccaagacatctttgtattaatacaaggaagtttatgagttggggcagggaaaacagagatggaggagatgaaactcgtgataagattgtcataactcccaaatatattgtaatcacagatctaggttggtttctgtcagagacatcaccattccaccagtctcccttcctggaaacctagaaatcttcactttttccgctgtcactttctacatctaatgaatagatccctattgattatttatttagaaaaatctctgaccgggcatggtggctcatgcctgtaatcccagcactttgggaggctgaggcaggcggatcatgaagtcaggagatcgagaccatcctggctaacatggtgaaaccctgtctctactaaaaaaaaaaaaaaaaaaaaattccaaaaattttatcggg

SEQ ID NO: 6553 - DNA, 530 bp, Homo sapiens
taatccaggctgacaagagcgccctgatgttgcaatgtgctgagcaagtagtcagcctgcccattcagcttcctactgtgttcttttgctaaatgctttctaatctcttaatgtctcttttgaaaggtggggacccaaactgtatgcattgttccagatgcgctcttgccaaagcagcataaagcaaatgtaacccttaggaagaaggctccctccctcactaggtaagtacaactggcagccgtggccagggccagctcacctgcccactagacctgccacaccttccactgccaggatgctggtgggacctcataaaatctgaacctgttcatccacaggacctgtggatttcaagtcaaaggaactgaccaagagcaacctctatctttacagcctctgattccatcccttccaggttctttcccaatagtttgcatctcttgggctctttgccaatcaagaacatcatcctccaatttaataattttgaggtgagctagaatttattaaaatgatgttttacctgt

SEQ ID NO: 6554 - DNA, 627 bp, Homo sapiens
taatccaggctgacaagagcgccctgatgttgcaatgtgctgagcaagtagtcagcctgcccattcagcttcctactgtgttcttttgctaaatgctttctaatctcttaatgtctcttttgaaaggtggggacccaaactgtatgcattgttccagatgcgctcttgccaaagcagcataaagcaaatgtaacccttaggaagaaggctccctccctcactaggccactgctgcaggacagtgaagctgacttaaaatgcccctgccctgggctacaaagaatgctagagtggagacaagagtccagactctgaaataacctcctttggacacagaagctaccactgttgcttatcagacgcagcgggccctgggtttttctggggccttaagcagtgaaccctggtcagctggcctgagtcccaacccaagcccatcaccacaagcctcaagacaggaagatctcagtgaaacctttcctctaatccaagtgacatcattgtcgcaggtgtttgtacatgaaagcagagtgatgaaggtgtgtgggtccacggaagaagtaaaaatacagcactagttcatatttttcctagtctctccctgttcccaggtaaagttatagcatg

SEQ ID NO: 6555 - DNA, 474 bp, Homo sapiens
ctgctttgttttttcagtgtttcctgcaagctgcaaatgggctgtgtggccataaggctggacaagagcatcacacagaaagccaaggtcctctagggtcacagccaccatcttagatttaactcttagactagcaaggagtatatatttctggcaaaattccagaaatgattaactagatcgcttatgggcaactggtgaatccacactgatctctgggatcaccgtttccttttctaagaagtcacgcaagaccaacctcatggcttttttggatcaggctactggatgggaacacgggagagtgcggcagctgagccaccacgcccagcctccacatgctttttaaaaacattcccgtgtttaaaaaaagttaaccacggggcttttaagcaccacatgctttaaatgccccttggtgacttgagtgttctactcagtttatcatgaatgtttttctgggacaactgacct

SEQ ID NO: 6556 - DNA, 2438 bp, Homo sapiens
gaataactctcatgagatctgatggcttttataaaggggcattcccctgcacacaccctctcttgcctcctgccatacgagatgtgtcttgctcctccctgtcttccaccatgattgtgagtgaggcctccccagccacatggaactgtgtcaattggacctctttcctttgtaaattgcccagtcttgggtatgtctttattagcagtgtgagaacagactaatacaagtagataggtatcttttaacttgtttccagtgactcttgctttactttcaggtggatgatgacagaatggaccccttgttcacgaacttgtggaaaaggaatgcagagcagacaagtggcctgtacccaacaactgagcaatggaacactgattagagcccgagagagggactgcattgggcccaagcccgcctctgcccagcgctgtgagggccaggactgcatgaccgtgtgggaggcgggagtgtggtctgagtgttcagtcaagtgtggcaaaggcatacgtcatcggaccgttagatgtaccaacccaagaaagaagtgtgtcctctctaccagacccagggaggctgaagactgtgaggattattcaaaatgctatgtgtggcgaatgggtgactggtctaagtgctcaattacctgtggcaaaggaatgcagtcccgtgtaatccaatgcatgcataagatcacaggaagacatggaaatgaatgtttttcctcagaaaaacctgcagcatacaggccatgccatcttcaaccctgcaatgagaaaattaatgtaaataccataacatcacccagactggctgctctgactttcaagtgcctgggagatcagtggccagtgtactgccgagtgatacgtgaaaagaacctatgtcaggacatgcggtggtatcagcgctgctgtgaaacatgcagggacttctatgcccaaaagctgcagcagaagagttgacctctagcaggctggctggatcacagctctttgcaattacattatttataaacacacacactagcatgtttttcagaccaaatattatcagattacatataatttaatcaaattaatttatttttttgcctgccaaacatccaatgtggtgcttgttttggttacacaaacattttgatttatactatatggcttcataaataattttatatgaatgaattagttggatccagtaatataataaaaagaaaaaggaaaaaaatagatcattatacttaaaacaaggtttcgttgtttgttagggctatctctaaggtgctactctctccccaccaataacattgaattatccagaatgtatactgacttagcataatagtttaggtgtatatgaagagaaactatttttgttttttggtgtcctgctgcagaattagcccattttctgtcacctgcaggagatgtgtaaacataatgaacctcatgctgttgaacaggtttttagagaatgtattatgaatttggttcagatttatagacatccataggaaaaattctgctgtaattataaccttattttgatatggaaaagaaaagtcaaaatagagactttgatcatgttcatgaacatgtacttgaacacaagtattgtaacaatgaaacactgtaatgatttacactgaatcacaattgcactgttgatatagtgtagagaaatcgttagaaatggtgacatcttacaaaaaatgtgtattattttaacatgttatcactagattttagctttttttaaatatttttaacaaagaaaacattgatccacccatttccctgtatctttttagcagatttattaaagagtatagtacttagcctcacgaatcataattagaaaatttactagtatttctcagccttttccctaggaacaaggaaaaacagaaagcatataatacggtggtcgtttcattgtgtttttcttccttttaaaaattaaaaagttttacaattatgtgaaacgttcaaaagccagcttaaaatttttcttgtgagaaaatattatacatgattcacatgatttcttagatttttcaataaaatatgtaaaacttcccactgagagacaattcttcatagacttgtcacatatccacatgtctgatgaacaaaggtactgtctacttttgttctggagtatcttctagaggatgtttatagagtgaactgccttggaagatagtatgtctcttgggagcaaagggcaaacatacttctcattataaaagtttcaggttccctaaaattggggtttctttactataagacaatccaatgtatgttctgaggtcacctggctctcttcatgtcaccctttgggaaatggggctcaacgagccagtacaggaaaagctgattccctggctactactatcgctgtgagtaataaagtcctttgtctctaatgcagga

SEQ ID NO: 6557 - DNA, 2345 bp, Homo sapiens
tcatgtggacacacacaagctgggaagattgcgatgccacttgtggaggaggagaaaggaagacaacagtgtcctgcacaaaaatcatgagcaaaaatatcagcattgtggacaatgagaaatgcaaatacttaaccaagccagagccacagattcgaaagtgcaatgagcaaccatgtcaaacaaggtggatgatgacagaatggaccccttgttcacgaacttgtggaaaaggaatgcagagcagacaagtggcctgtacccaacaactgagcaatggaacactgattagagcccgagagagggactgcattgggcccaagcccgcctctgcccagcgctgtgagggccaggactgcatgaccgtgtgggaggcgggagtgtggtctgagtgttcagtcaagtgtggcaaaggcatacgtcatcggaccgttagatgtaccaacccaagaaagaagtgtgtcctctctaccagacccagggaggctgaagactgtgaggattattcaaaatgctatgtgtggcgaatgggtgactggtctaagtgctcaattacctgtggcaaaggaatgcagtcccgtgtaatccaatgcatgcataagatcacaggaagacatggaaatgaatgtttttcctcagaaaaacctgcagcatacaggccatgccatcttcaaccctgcaatgagaaaattaatgtaaataccataacatcacccagactggctgctctgactttcaagtgcctgggagatcagtggccagtgtactgccgagtgatacgtgaaaagaacctatgtcaggacatgcggtggtatcagcgctgctgtgaaacatgcagggacttctatgcccaaaagctgcagcagaagagttgacctctagcaggctggctggatcacagctctttgcaattacattatttataaacacacacactagcatgtttttcagaccaaatattatcagattacatataatttaatcaaattaatttatttttttgcctgccaaacatccaatgtggtgcttgttttggttacacaaacattttgatttatactatatggcttcataaataattttatatgaatgaattagttggatccagtaatataataaaaagaaaaaggaaaaaaatagatcattatacttaaaacaaggtttcgttgtttgttagggctatctctaaggtgctactctctccccaccaataacattgaattatccagaatgtatactgacttagcataatagtttaggtgtatatgaagagaaactatttttgttttttggtgtcctgctgcagaattagcccattttctgtcacctgcaggagatgtgtaaacataatgaacctcatgctgttgaacaggtttttagagaatgtattatgaatttggttcagatttatagacatccataggaaaaattctgctgtaattataaccttattttgatatggaaaagaaaagtcaaaatagagactttgatcatgttcatgaacatgtacttgaacacaagtattgtaacaatgaaacactgtaatgatttacactgaatcacaattgcactgttgatatagtgtagagaaatcgttagaaatggtgacatcttacaaaaaatgtgtattattttaacatgttatcactagattttagctttttttaaatatttttaacaaagaaaacattgatccacccatttccctgtatctttttagcagatttattaaagagtatagtacttagcctcacgaatcataattagaaaatttactagtatttctcagccttttccctaggaacaaggaaaaacagaaagcatataatacggtggtcgtttcattgtgtttttcttccttttaaaaattaaaaagttttacaattatgtgaaacgttcaaaagccagcttaaaatttttcttgtgagaaaatattatacatgattcacatgatttcttagatttttcaataaaatatgtaaaacttcccactgagagacaattcttcatagacttgtcacatatccacatgtctgatgaacaaaggtactgtctacttttgttctggagtatcttctagaggatgtttatagagtgaactgccttggaagatagtatgtctcttgggagcaaagggcaaacatacttctcattataaaagtttcaggttccctaaaattggggtttctttactataagacaatccaatgtatgttctgaggtcacctggctctcttcatgtcaccctttgggaaatggggctcaacgagccagtacaggaaaagctgattccctggctactactatcgctgtgagtaataaagtcctttgtctctaatgcagga

SEQ ID NO: 6558 - DNA, 483 bp, Homo sapiens
gtgcagtgacttatattaaagaccagaaagttcctgtagtaaagatatttatttatctttgtttttaagaggagcgctaagctcccttttaaataatagctatattttattaaatactgctattcacagtttgaaaaccactgatatagatgcttaaatacctcacaaaatgtccattgacattaaaaatagcaaacattgacaaacatccaaatatcacaaaaatatagagcttgaaataaaatcagaaatgtaaggttgttttaagggttaaatgagatgatgtgaagcaatttacatggcatcaagtacatagcaagtattgaaaaaaagtactgacttatggccaggtgtggtggctcacgcctgtaatcccagcactttgggaggccgaggcaggcagatcacaaggtcaggagtttgagatcagcctggccaacatggcaaagccccatctctactataaatatctctactataaat

SEQ ID NO: 6559 - DNA, 488 bp, Homo sapiens
ttgtgagaagtcaggagtcacatcagaaacttgcttttcctcagcggcacctcctgctcgtgacgggccctgttcctttcccctcagagacgtacctgggatccatcctggcctctcagtcagggccgacttccccaccccagtgtttgctaccatgattgtgacctgttctaagctgagtttctgcagctttgccggtcacatgcattctttcctccccaagacaacccctcatcacacagcagagacagtggtcactgagaacatggtctgcctcccatctctccccttcgtgggcacctcagtggcctcctctgcgctccgaacaaaagcaagagaccctgctgaacctgggatgggttggtagaagatgggctccccacgggacccgggcggggacagccccctcagcctcacggcttcccagacagagcgaaggtgtccttccagtctctccacatgtcatcttaaataaagttagttaattc

SEQ ID NO: 6560 - DNA, 375 bp, Homo sapiens
gaacaggtaaggtgtcagggaaggtgaaatggatggtggtgatggctacacagcgtgaataaattttatgctacaaaactgtgcacttaaaattggtgaaaatgcaccacaaagaaatgataaatatttaaagtgatggatacaatacagcaattaccatgatttggtcgttacataatgtgtgcgtggatcaaaacatcataccgtacccgacgattatacataaccattatgcatcaattacaaatttaaaaattggccgggcacagtggctcacatctcttaactccaatacttcgggaggctgaggtgagaggattgtttgagtccaggggttagagatcagcctgagcaacaaagtgagacctcatctct

SEQ ID NO: 6561 - DNA, 300 bp, Homo sapiens
ggcacttgtatttccttgcttcatgtgatatttaattaaatcatatagaatattaagtacatttcatacgaagaagtagagcattctagagagagtcacctgttcacagagtgtcatcgtactctgggcatcaggcagtatgattttcaaagggaataaggggcatcaagctagtgaagtgaaggttggttaaaagcttcctttgtagttatatttagaatagtattcttgtgggaaactgtatttagtagcatgctcctatagtgtttggggagtgagataggcacttcatgtttacat

SEQ ID NO: 6562 - DNA, 406 bp, Homo sapiens
ggaaagtagtgctagcaagtcaggaggagtgtattcttctgtgtttgtacagccccagtgaaatgaatcctctgaaagtagtcagtctcttctgttttttcattttccaggttgcatgggcctcagtctagatccaagagaccggcctcttggatgaacaaatgcacgcttaacctttaacatgggaccagttcttggcttccttgcttagggagcatgaccactcttggggctgtgccgactctccgttataaccagaaagtgaagatgctttttctcctcaccccctgccttccctgcgccagtgccagcacatttctttagggacattatgctatttctctaagcctgaaagtgataaagaggaaattatgtaacatttgctcagttgctatttaaaaaacaa

SEQ ID NO: 6563 - DNA, 341 bp, Homo sapiens
gaatctaatgcctaatgatctgaggtggaacagtttcatcctgaagtcttccccgcaacccctcttcccccgagtctgtggaaaaattgccttccatgaaatcagtccctggtgccaaaatggttgggaactcctcctttagataaaactggatacatcccttataacatagacatcagtttgaataaactgtaaatggcacaggtgtaaatgtaacagcacctgaacccatgcaagtattaggagaaaacatgaatgagttccgttatataacctccgagtctggaagcaataagagaaaaggttgataaatttaagtacatttttaaaaagttggatga

SEQ ID NO: 6564 - DNA, 528 bp, Homo sapiens
gggaggtaattgaatcatggggccagtctttcccatggtattctcgtggtagtgaataagtctcacaagatctgatgggtttatcaggggtttccacttttgcttcttcatcatttttctcttgctgccgccatgtaagaaatgcctttcacctctcgccatgaatcggaggcctcctcagccatgtggaactgtaagtccaattaaacctctttttattcccagtttcaggtatgccgggtatatttaagggttttgcttttattgttaataaagccatgtttttgtgtgatggggaaggagccactggtccagaggacaaaagggtaaaagtttttgttaaaaataatttatctgacagtgaatagtgaatcattcacactcttttatttggctgttacattctatgtgcaaaaatgtatttcctaaatgtagattgaatgtaatcagtgacatctttacccataaactggaaatatgcataatatcgatctgccatggtaaataacagatttgtaactattaaaa

SEQ ID NO: 6565 - DNA, 266 bp, Homo sapiens
ggaaactccatcaagaaaaaaaaaaaagaaagaaaagaaaacgtcagctatgttgtaagcaaagcttcaatacgttgctgtgaaccataccattctacgtagcagcaacaatgactcagcaatgattcagcaaatgaatcatgcttcagtcccagcacaattttcttctggtcagtgagtatgcagctggagaagcctccttggccaagatcacagcaaggataggctgtcacaggtgcccttccagcgaggggagggagctactg

SEQ ID NO: 6566 - DNA, 419 bp, Homo sapiens
tcataggctaatcataattgataggtcatattagatatagaaaaacaacacaaaatattgtcagttctgcagttatatgtatgtctgtggcatatagacataccctataataaaaagaaatagaacgtgttgagttcaaactaaagggtaactcaaaaatcatttaaatctgcctttggtatcattatttaagattttgtgtgccgggtgtgatggctcacgcctgtaatctcagcactttgggaggccaaggcagccagatccattaagctccaggagttcaagacccgcctgagcaacatggcaaaaccatgtctttacaaaaaatttttaaaaattaggcacggtggtgcatgcctatggtcccagctactcgggaggttgaggtgggaggatcacttgagcccaggaggtcgaat

SEQ ID NO: 6567 - DNA, 341 bp, Homo sapiens
atcgaggggacgttaattacctgtctttgtgaattaagcagtttatgagcagcaagttactgaggaccgtaaataaagtcatagagagctcaaggaagtaatagcttcggtttaatcatctgcttcaaaggtgccaatttttacatactactatatgtaatgatttgttctaaattgcttgttccttttgaaaaaaatttaaggatgttttatgaaaatgaccatggaggtctcctgcttaaccaatatactttatatttatagttagagggcccctccttgatagatttgaatgaggagctggaaagcttgggtacaattttcatgactagtttgtatta

SEQ ID NO: 6568 - DNA, 461 bp, Homo sapiens
agattattctaaaatgtatttgaaaagacatgaactagaacagctgaaacaattttgagaaaaggaggataaaaagataggaatctgtatgtccggtttcaaggagttatatagctaccataaacaggatagtgaggtatttgcagagggataaacagataaatggaacagaatagagaacctagaaatatctacacacaaatatgcccaattgatttttataatggtgcaaaagtaattctgtggaagaaggatcatctttcaaaaaatggtacaagaccagttagaaactcacgggaagaaaggagaaggagaaaagaaggaaaaagagaaagacctcaccctaagtctcaaactttgtacaaaaattaattcaaaagagatcacagacttaaatgtgaaatgtaaaacaataaatcacttataaaaaacaaaaaacagaaacaaaaacaaaacaaaac

SEQ ID NO: 6569 - DNA, 260 bp, Homo sapiens
actctctgctctggtagacgggaagagcattaatgctggaggccacaaggttgggctcgccctggagttggaggcttaatccagctgaaagaaacctttgggaatggatatcagaagatttggccttaatatatttccattgtgaccagcagcaggcttttttcccccaagaagatgatcaaaacaaaggatgatctcaacaagagctgtattttaagtatttagacagttctttgttagctggtttctagttggttatc

SEQ ID NO: 6570 - DNA, 722 bp, Homo sapiens
gccttctgtgcctcagttccctcctctgtatcacatgaaggtgcatggatgggactaggtgggacaggcactcccacccactcagagctcccaagtccaactacctcacggaaggccgcctttgtccttggccccacactgggtccagtctgtcgcagtggagtgcaggcctgtggtacaatgcaaggcgaccacatgtagttcctgcaccagagagagccatgggatggggggctgagttaaaaactcatagacccctcatcaacacagtggccagcacatgtgcagccctgtgccagggaccctggagcttaccacccatgctcctccagcccatctggagctcctgcccccaaccccagcaccctatttatctatagctactgcaccctggaatgcaccctaatacattttcctggatctcacctgtgaatttccccatgcccgaaaatattcccacactggcccatctgctccagggccttggattccaccattcaaccctgacctccctttgcaatactgaactcgaagactcttgccgaggtttcaagtgtgtccccgctcccagggcctgggatctggccagggagggctggaaagaaggaaatgcgccacagatggaggaagtagcttcggcaaggtgaagcacaaaggcaaactttgctgacagaagactcttgctgctggccaaccaggcctgcctgtcatgagaatcaaaa

SEQ ID NO: 6571 - DNA, 579 bp, Homo sapiens
tttaccagatatttctagttctctcttttgggcacaaaatagaatttagtgctggggacacagtgagagacatgtgattcaccacagaagtttcaccacagaagggttgaattgagccagaaggattgaggatatggcactaactagcggtgtttgagatggtgttggctctatcagccgactgtagtgagcagagccctcctcctgatctatgactgaggcatggtctaagtgagaaactaatgttggttgtttttaagccatggaaatttgggggttattatcactaacctatcctgacatggaaatccatgaatgtagttgggtgtggtggctcacacttgtagtatcagcactttgggaggttgaggtgggtggatcacctgagtgaggtcaggagtttgagaccagcctgaccaacatggcgaaactgcatctctacaaaaaatacaaaattagccaggtgtggtggcgcatgcctgtaatcccagctatttgggaggctgaggcaggagaatcgcttgaacctgggaggcagaagttgcagtgagccgagattgcaccactgcactccagcct

SEQ ID NO: 6572 - DNA, 1667 bp, Homo sapiens
gtgaagggagccgggatcagccaggggccagcatgagccggagggagggaagtctggaagacccccagactgattcctcagtctcacttcttccccacttggaggccaagatccgtcagacacacagccttgcgcacctcctcaccaaatacgctgagcagctgctccaggaatatgtgcagctccagggagaccccttcgggctgcccagcttctcgccgccgcggctgccggtggccggcctgagcgccccggctccgagccacgcggggctgccagtgcacgagcggctgcggctggacgcggcggcgctggccgcgctgcccccgctgctggacgcagtgtgtcgccgccaggccgagctgaacccgcgcgcgccgcgcctgctgcgccgcctggaggacgcggcgcgccaggcccgggccctgggcgccgccgtggaggccttgctggccgcgctgggcgccgccaaccgcgggccccgggccgagccccccgccgccaccgcctcagccgcctccgccaccggggtcttccccgccaaggtgctggggctccgcgtttgcggcctctaccgcgagtggctgagccgcaccgagggcgacctgggccagctgctgcccgggggctcggcctgagcgccgcggggcagctcgccccgcctcctcccgctgggttccgtctctccttccgcttctttgtctttctctgccgctgtcggtgtctgtctgtctgctcttagctgtctccattgcctcggccttctttgctttttgtgggggagaggggaggggacgggcagggtctctgtcgcccaggctggggtgcagtggcgcgatcccagcactgcagcctcaacctcctgggctcaagccatccttccgcctcagcttccccagcagctgggactacaggcacgcgccaccacagccggctaattttttatttaattttttgtagagacgaggtttcgccatgttgcccaggctggtcttgaactccggggctcaagcgatcctcccgcttcagcctccctaagtgctgggattgcaggcgtgagccactttcccagcctctctttgctttgcctgccccgttctcttaactcttggaccctcctcgtctgcatggtaactccgtctgagtctaccattttcttgctctccctccttccttgggcctgcctcagttccctttggcctccccctttacccagctcttggggtgtctctgttttttccatccccacttcctgccttctcgtggccctgtgtgagcacatgtgtacatctcagccttatctcaaggaggtgacaccttctctccttgtccccatctggccgtctctctgtgcttccctggccaggggcgtgcctgctggtcctatggggggaaggctactccgcatctcagccaccttcctcaggctcactccacctacatccccagtctgccacaccccatccctttgggcctcagccctgtccctttgatgtcctcctttccttcagcccctctgccctgtccctgcacacctccactgcctcccagcagatctgtggagacaaaacaagcaacaccttaaaagagttttatttctgaaaataaattaattttttgtaaataaaatgtttaaaaataaaaaagaaactaaagttacttgtata

SEQ ID NO: 6573 - DNA, 398 bp, Homo sapiens
ttttcccctaaaagggccctttcaactctttctgagatcatacaagccctgagttttgacacccagggtctcaacttcctgagcccttgcctctcagagtcctaaatttcccctgtacattcctgagtctggccagtgatcaccctcagtcacttagggacgggagggctgggagagccctggaagattccagacagaagctggcaaaagcccagggtgtgggcaatatccactctccagcctccgtttctccactcgtaatgaggagtccttccctggggtcagcaaaccttattcaaagggagacctctcagtcacccaagattcctctagacaatgcgagctttcctacctacctacctaccagctctgagcttggtacacccagagccctgttt

SEQ ID NO: 6574 - DNA, 388 bp, Homo sapiens
gtcctgtttagggcacctggtaattagcataatggcctcttgggccctgcctcagaatgctgggtggcatgtatcacagattcatctgggaagcagcttccactaaccagggaaccaaggacaaaggagctggcaggcttcaggggagtagctgcccagtcaacagtgtattaaggacagccattagttgccacaatcagttaattagctcaacaaatgcaaaacctaaatcattaaataaagtggccctgattgcactgctgacttctgatttggtatcactaacccagcagggtgagaatgaggtagttccacaaaaaataaaaacctgtccacattgggaaaatgatataggatgggatttcattttcatgaaagttgagccctg

SEQ ID NO: 6575 - DNA, 659 bp, Homo sapiens
cctcatcatatcactttttcatttttaatacaattgcaaaatgagtcaaatacactgttctattttatagtcacagcatagagtaatgagcaaacctaggttttttcaattttggagatctaaactgccatgtacacagtctaagctaccctgcaggagagctaggtcatgaggaaaagccctggagattgaggtatcatgtcaaaggaagccacatggtaccagacatccaaaccacagccgcagctgactgcaaccacaggagagactgtgagaagaggtgttcagctgggccctggacaacccacaaaattgtgatacaataaaatggttgtcggtttaagccacaaagtttggaaatggttacacagtaatagatcattgaaatggctggctcttctttgtcttcttcttattattattattactttgagacagtcttgctctgtcacccaggctggactacagtggtgtgatctcagctcactgcaacctctgcttcctgggttcaagcgattcttgctgaaacaactggctcttattaaaaatgaagctaacttaggaaactgggactacagacatgcaccaccatacccagcaattttttttttttttttttttttttttgtagagatgagatctcactatgttgcccaggc

SEQ ID NO: 6576 - DNA, 511 bp, Homo sapiens
cttgaacccaggaggtggaggttgcagtgagctgagattgagccactgcactccagcctgggcaacagagtgagactctgtctcaaaaaacaaaacaaaatgaaacaaaacaaaacaagtcaaacagtacaaggagtcttctcttcttccttccagtcccacccctctataatgaatgagtgataatggtaacagtttggtggtctccttcctttttgatgcttatacaaacatgttcaaagatatatgtgcatataagattctttcaaacactggatcgtactgtaatatattaaaataacagactcttttcacttaacattttttcatggacatctgtccagatcaatccatttatatataacttattttttatagctatatactagtatccttagaatggatacattatttattcagctcacctccttgtttcagaaatttaggttatttctaggtttgttttttactacttcaaacaatgctgcaataaacattcttgtacatcaaa

SEQ ID NO: 6577 - DNA, 491 bp, Homo sapiens
gatgaaatatttactcttttttttcttttttctttaagttttttgttttttaagacaagatctcactctgtcacccaggctggagtacagtggcacaattacagctctctgtagcctcaatctcccaagcttaagtgatcctcccacctcagcatcctgagtattggggactacagctgcatgccacctcatctggccagttttttgtagagacagggtttcaccattttgttcaggctggtcttgaactgggctcatcaagtgatccacaccttggcctcccaaagtgctagaattataggcatgagctactgtgcatgaccaaagtatttactctctaaccgacttttctctctctctttgcaagtaagggaattatgggacttaaacctactaacaaacatctttatctcatcccagatgcttgggtggctaaggtggaaggatcgtttgagaccggcctgggcaacatagaaggaccctgtctcttt

SEQ ID NO: 6578 - DNA, 501 bp, Homo sapiens
ccggcctcctgaccgaccgtccatccaccaccaggcttctggatgttcacccatgtgggagagacgggtgtcggggaagggaccacagcttcctttcagaagacccgggaagggcagtgccgtgtgccagcctcccagttggcaccttcctttcaccttagtcgtcttcgaggcgatgtttcctcgggacaagtcattttcatgaatctgctgtaaaacgtctcccaaactccaagtgtttcccaaactgagtgaaaatcgctgcagaatgtggtttccagcagagcttttcccctctccttccttcacctctgcctgggttacagggtgcgggttccaggagtctgcctagaaggcaaaaaacaggctttgcttagaatcccctaaattgctcataaaacacagtgtttgacgtttatgtgtagacatgatccttatgtgggttaagctgaggcccctgccccagtgacacagaggcctcaaacggcacagtgcaccttc

SEQ ID NO: 6579 - DNA, 1199 bp, Homo sapiens
gtggagaatgaaccatgggggcaaaagcagaaacaagaagaccacttaagaggctcttgcaataatttatgtgagaagagtgatcatcttgactagggtggtggtggtagaggaggtgagtggtggtcaggactgagaggagccaacagaatttgctggcttgcttggatgtgggtgatgaggcaaactgagaatccaagatggcaccaaggcttataccctgagcaactgaatggatggtggtgccattcactgagatgaggacggagctgggtttgagcagggataggggaatctgtcaatcaagtgacatggctagtagcaattgcatatacaaatcaggagagactgggctaaagacacagatttaggggtcatcgtcatagagctagtacttgaaatcttgggtctggatgagatcatttgggaagtaaacgaacagagatagagaagctataatgtcccaggctgagcctgccacaatttgaagttggttggaggaggagctgctacgtgaggtcaggaatgttgaatgcacccagggtgacagtgttgaggaggacgccctgttgtgtgtcctctcccatctcatccctgccctttcccacactcccagtggcccttctcccatctttcctgcagatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctgggtgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6580 - DNA, 1868 bp, Homo sapiens
ggccagcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccaggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctgggtgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6581 - DNA, 1755 bp, Homo sapiens
agcggagggcctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctgggtgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6582 - DNA, 2031 bp, Homo sapiens
agcggagggcctgaatacacagagcgctgagagagtggggcagtgtggtcacggacacaggcagggactgggatgtgacaggctggagctcagggacttgttgggggaatgggggtcagtgacaggctggaggcttaatgcgaggatggaggcttggctctaggggcagcacctggggtggtcatgggatctcagggaggggagtgggagtcagagaaagggtcttagagaagctggggctttgtgaggagctaagggagactcactgatcgaggtggggaccctgcaggcagaaacctgactgtagtgatagaggtggggtttctccgcacgcaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctgggtgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6583 - DNA, 2069 bp, Homo sapiens
ggccagcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccaggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctgggtgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacaggtgagggacaggggtgtggggatacagaaggtgccaggcatcagcctcaaggaccgtgaccttccaaaatgcctcctatctccctcatcacccctgggactcagaagggagggcccatcaagcggggagaggggtgggaagacaaaagtcgctgaggatgcagtgctgctcctgagcatctatgactccctccccacacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6584 - DNA, 1637 bp, Homo sapiens
ggccagcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccaggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccttcttcttcttcgggcccatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttgcggaaacgcactttgaccgtggcatcaacgactggctttgcaaggtccgggccctgtttggagccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6585 - DNA, 1214 bp, Homo sapiens
ggccagcagctctgcagcactcggctctgctccactctgctcagctccgctccaggaaggccacctcctcctccccctcctcctcccgctgtcaccactcaccgctcataacctcaagggggtggggaccccagggctggacacaccccaccgtggccccagagctcagccggtcgcacggacggacagttggaagccggaccccagagcctgaggtgggcagtgtgccaggtcccttgcggcctcctcaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcaccagctttgcactggagagctgtgcccaccctgaccgccactactccttagctgacctgctcaagtacaacttctacctgcccatgaacttctgggccatcatcatgtacaaccttgtgagcctgaacagcctcaaattcacagagctggttgcccggcgcctgctactcacagggttcccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaaca

SEQ ID NO: 6586 - DNA, 324 bp, Homo sapiens
gtgagcagggaagacctggggctgggactggctgggtcatagagggcgggggggcactgctgctttctggagttgtccaaacacctggcccctaatccagaactttctcaccaccaccctcttagttgtcagagcaatggctcactctgtaggaatctgcccctccctcccttctatgaggaatggagcacctgggccttgccatgttggtcaggccttgtcctctctctggacctgtttccccatgtttaacaaggagggagagctgacctggggctctccgagacccagacatagccccaagacctgactggccaggtgggt

SEQ ID NO: 6587 - DNA, 444 bp, Homo sapiens
ccccactggggtggtgggaccatgaggtggggctaggcttggctggagactgtaattccctcacccaacctgtctccccagccctgtccaggctatgggcatcaagacagcattgccggcggctgagctgggcctctactctctggtgctgagtggggccctggcctatgctggccggggcctccttgaggcttcacaaggtaatggctgtgccccggggcaggtggacaggacccttcttcccctggaggcctcagggttccaaccagcaaagccagaaagttacaggctccagacctagggtactccttctagaacacggctggatctcccttttcagcccggggttcccatctcagatagtcactggaggctgggtggagccaggttcagtcacaggaacacagagatgcagagacactgacagagagatggacacagagt

SEQ ID NO: 6588 - DNA, 434 bp, Homo sapiens
acatttcgttttaacacatttttatcattagcaaactagcatcatttgagcaatgctaaatatagtgatgttattgggttcctaacagaaaacctcatattcttgaatgtttacttctttgatactttcataatttgagtatttatatatttttaaaaattttcaaatctttgtttcccctgcccgccgcctctctctctctctctcttttttttttctttttttagggacagggtattcctctatcacccagactggagtacagtgacaaaactgtagctcaccacaacctcaatctcctgggctcaggtgatcctcctctactcaggaggctgaggcgggagaatggtatgaagccggggggcggagcttgcagtgagaagagattgcgccactgcactccagcctgggtgacagagcgagattctgtctca

SEQ ID NO: 6589 - DNA, 361 bp, Homo sapiens
aatttttcttatgtcaggaatgaatttggaggtatatggtagctggtggtgattccactgctcaaaaatgtcatcaggccagccagtggctcacgcctgtaatccctgcactttgggaggctgaggtgggaggatcgcttgagcccaggacttcaagaccagcctgggcaacatagggagaccccatctctacaaaaaataaaaaaataggcaggcatggtgacatgtgcctgtagtctcagctatttgggaggctgaggtgggaggattgcttgagcccaggaggttgaggatatagtgagctgtgatcccaccactgaactctagctagggcgacacaatgagattctgtctcaaaaaa

SEQ ID NO: 6590 - DNA, 502 bp, Homo sapiens
tgcaaactcatatgctccagacagctagatagttacaaacgcatagagaaatacttcaaggcctatatgcatatagcagcacaattcgcagttgcaaaaatgtggaaccagcccaaatgcccatcaatcaatgagtggattaaaataaactgtggtatgtatatatgatggaatactactcagccataaaaaagaatgaaataatggcattcacagcaacctgggtgggattggagactattatcctaagtaaagtaactgagtagtggaaaaccaaacaacatatgttctcactcataattgggagctaagctatgaagatgcaaaggcaaaagaatgatacaatggactttggggactcagagggaaagggagggaaggggatgagggataaacagtgtatattgctggggtgatgggtgcaccaaaagctcacaaatcaccactaaggaactggctcatgtcgccaaataccacctgttcccccaaaacctatggaaat

SEQ ID NO: 6591 - DNA, 689 bp, Homo sapiens
tctccttgactgtgacagacggcactcacactgatttctatgtcctaccagacactgccctggcgacacacaaacctcaagtaatgagggtccagataagatcattagacaataggcttccccagattactaccaacaggggtgccccagccttgaagcgccttcacactggacacatgggcttcctgattaccagcaagtctctgaaggcagaagatcaggacagtccccacaggcttctgaagtataaagtgaccagaggaccagagcatggcttcattatcaaaactggccttgggaaaccagagcactcgagtgttttacacaagctgacattgatgagatgaagatatcctatgtctttgaatgagggcagcaacgcattcaaagggacatcttctatttctctgttgaagacaatggaggaaataaactaacaaatcagcctttccatctaaactgggcttggatttgtttggagaaagagtactacattgtggatgaagattccacattcttagaagtgacccttacacgcagaggataccttggagaaacatcatttatcagcattggtaccaaagatgaaactgcaaaaaaagacaaagatttcaaatggaagaccaataaacagatccagttcaatcctggacagactacagccacatggagggtgagaattatacctg

SEQ ID NO: 6592 - DNA, 196 bp, Homo sapiens
gaagtcctgttagactgatactgtaggagaacatgtatcccattgtattgcaattactaaccatctctcttggagtagataatgattcttacctttgttgattaggatcacctgaagaactcttaaaaacaaaaacaggaatctctcagacccttaccctcgaattgttccagagtagagcctagctattgagatt

SEQ ID NO: 6593 - DNA, 154 bp, Homo sapiens
cataccaacatataaagattattttacttaaagctattttaaattcaagatatggggaacatctactctccagatggaggagaaagggctgaatcaatacagggggaattagttgtattttataatttttcaacaattagagtaaaaaaaaaat

SEQ ID NO: 6594 - DNA, 610 bp, Homo sapiens
aaaataagcaaacaaaccaactgagaaggatttacccattaaataaaagacagatagactttgggcctccatggtattcttgcctggggctgctcccatcatctctccagctcaagggtcttggtagttctaccagggcagggctggtcatgaaaaccagcagcttcactcctagcagggctcactcgtgtctagtgggactgtcagtaaaataataaggctagtaacacacatgcctcatagtctgaggttgctctcacagatcgggggcatttcaggctggcagactagccagacatttagcaaagagatcctagaaatgagagcactgcagaaagcctagataagaccccaggcagacggggatgggatgctacacacatgctcatgggacacccagaagggcccagttgaaagtaaaacccagggaagacttgaaaactgtctgaacttggaacatgctcctgttaccacatcagcagaaggtggaagctctgctggcttgaggtgtttgagcacaacatctgaccagtctttgggtgaccactaaactacaagatgcaggggaatcccgtgggaacccaggctagtaaaatgaaaataagaatta

SEQ ID NO: 6595 - DNA, 311 bp, Homo sapiens
ggtgaagttactgtgcaaagcagcatgcatagaggaataggaggaatgtagaggcattctgcagtctaccacacaggcccttacattattctcattataatcatacttaaacaccaagccactaaatgaggtgacacccttgtgcttgtaacagttatctaactatgaagctaggctcgattaaaaatgagaataccacaataagttaataaatttaaattaaggccattaatataatatgagtgatgttttgtttcgtttttgctgaaactaaattggctgtcaaaaaatggacatgtccagagaggcaa

SEQ ID NO: 6596 - DNA, 670 bp, Homo sapiens
taggcatgagcctctatgcccagcccaagaaacaaaccctgcttttagaatctttttttttttttcccagctgtcctgtgtcctaggtttataactttgactaacttctagcaacttccaatcatgggagaattagagtggttatctgggatgaattgtttgaacttcaacctgttatcttggctgcagggctttcttggccacagggccgtgctaaagggcactttgatttcttgattttaaaagagcaagagaaagtgattgccaagaggagaggtttggttggcttttcttagaactaactgcctctccagagaagcctgcattggctgctcatcatgatgagggtcgggcaaggtcagtttccactgtcttctaattgttttcagagaattggacggtacaaagcaggtgccactgacaacatttcccatcattttatggaagagtactgattccgtcttttctgctcagagtggatctgtgcaaataacttttgtttctcaaaaatttctggtttgtcttgggatgcagccaggcctctaatgtggtggtgtgtgctgtgtcacaaacctcggccccaaaagcctgagcttggctttgtcagatctgatgagtgtgcatgagcaggaagccacccttcgggagaattcaggggcaaacgtacaag

SEQ ID NO: 6597 - DNA, 265 bp, Homo sapiens
gaggatttgttgctagaaaacttactccaaaagaattgttaagggaagtttttcagatcaaagtaaaatgaaaagtaaaaggaagactttgaatatcaggaataaagagaaagcaacagaaatggtagatacttgggtaaatataacttctcgagctcttaaaaatacatttgatagataaaaacaaaattgtcatattatctgatgatttatttaatgtacatcagtgaaatatgtggggaaagtacaacataaattgaggaat

SEQ ID NO: 6598 - DNA, 642 bp, Homo sapiens
gaaggttgtcaggaagcaattttaaatttctaatatgtaaacatcggggctttggcatattttgaaccattttgatgataggaatggaggtggtaggagccaccctgattaagttcttgttgagaataaactggtgcaccagacatttacataggctgaatcaatgttgatggcagccgtgtttttaatccatgggcctaaaacagtgtccctcatacctgtctcttgctgaggcccctgtcgcaggtgagccatgtctgacttccgagccttccatcgactgctcagtccacgtcttcagccctatttcccaagcttacctagtgagtcctccttgactcaggctggttcctccattgtttctgccacctgcaggccattggtgctccttgaataccctgtggtgtcatcgctgactcgtgcctccagggctttcccgctctgacggctctgtgtttcctattgcttcatatagcttgcttctgaattagcatgcgatatgtgacactcatatgttatgtatcttggtttagtttttacagaaagatgaaagactcttaaaagggatcttggagttgttcttgtacatcttttatatctcctaagcctttgatgggcacttgttccaaatgggaaagaaaa

SEQ ID NO: 6599 - DNA, 399 bp, Homo sapiens
ttttcttaaagttgaaatcatttaccattggtattagacttcatattaaatttaggcagcatacaaacttattaatacacttgttttgagcaaacactaaagattttaatcagtggatgctgtggctcacacctgtaatcccaacactttgggtgaccaaggcagaaggatcatttgaggccaggagttcaagaccagcctgggcttcatacagagaatacatctttacaaaaaataaaaatatatattagccggcaccgtggcatgcacacctgtactcccagctactctggaggctgaggcaggaggatcactggagcctaggagtatgagactgtattaagctatgatcttagcactgcactccagcctgaacgacagataaatactttgtcacaa

SEQ ID NO: 6600 - DNA, 452 bp, Homo sapiens
tggtagtgtgattggaaggcagataaattttaggacacaatggaagttcctaagattttttatccttttccaataggaaggataaaaaaatcatctaaaactagaggaaaaatcatctaaaacaaggtataaagaaatggctcacgtgtgacccttattttactgtgacatggagcatttgatgaaggatgtgggaagggagcctgcttaactatgaagtgagtagcatcgccccaggagcaccatgacagatgcacaggacatggagggaaggaaatggcatcctgcacagccctggctctacattgagcaatgtagacaaaatcataaaggctgctctagttttctacttttagaatcaacctacagacatgtaagacttaattgtagttgtagaataaaagataaaagattattggctttcataacaataaagtcctaacaatgattca

SEQ ID NO: 6601 - DNA, 635 bp, Homo sapiens
ccctccacatttctcaggtttctgctcaaaagtcaccttttggaggggtctccacctgtcactgtgtttgtaagagctccttcagtttctttctagctcatctcactctggtaatgtctttgattaccaccaccatctgacctggtcttatgacctgttagctttcttcatcagacgtgagcaccaggatggcaggggcctcatctgtcctgttcctcctgtggcctgggtcctagcaccatgtctggtacagtgtagatgctcaagggaagtttactttgtagaaccacttacctgggagatgttactgttagtctaacctgtaccattttgtaaacctccagccattttgcagactctgatcacagtgaaacgttccatgggaacttgggccatgagaaacatccttcctaaccacgtgactgcagaaacatccttatcgcgtcctcctgggcaaaggcccaacagcctgactgcagggacatccttgccatatcctgctgggcagcaagctctaccacccagatccctccctcccagtcccatgattaccccagcctgtgagtggcagttggtgctggcactaagctggtttcctcctccccagggttttgctggcaataaagatgttgctg

SEQ ID NO: 6602 - DNA, 579 bp, Homo sapiens
ccccaccctgagttttcccctggttaggcaacgggcaggtgggggtggtggaaccaactctttagaaccagcaatgacaaacagatcccacttgggggaagttgatgttaagtgtcatgggtcctctggaattttctgaagctttcctgtttttttttttctccccctaaccagctcaactgatctcctgggatctctactaagatgttggcagcccggccagctggtctggccctggacgtgccttcatggtctggttatgcttcatgacctgcactgtggtcagtgccattttgcagactctgatcacagtgaaacgttccatgggaacttgggccatgagaaacatccttcctaaccacgtgactgcagaaacatccttatcgcgtcctcctgggcaaaggcccaacagcctgactgcagggacatccttgccatatcctgctgggcagcaagctctaccacccagatccctccctcccagtcccatgattaccccagcctgtgagtggcagttggtgctggcactaagctggtttcctcctccccagggttttgctggcaataaagatgttgctg

SEQ ID NO: 6603 - DNA, 604 bp, Homo sapiens
ccctccacatttctcaggtttctgctcaaaagtcaccttttggaggggtctccacctgtcactgtgtttgtaagagctccttcagtttctttctagctcatctcactctggtaatgtctttgattaccaccaccatctgacctggtcttatgacctgttagctttcttcatcagacgtgagcaccaggatggcaggggcctcatctgtcctgttcctcctgtggcctgggtcctagcaccatgtctggtacagtgtagatgctcaagggaagtttactttgtagaaccacttacctgggagatgttactgttagtctaacctgtaccattttgtaaacctccagccattttgcagactctgatcacagtgaaacgttccatgggaacttgggccatgagaaacatccttcctaaccacgtgactgcagaaacatccttattgccagcaaaaccctggggaggaggaaaccagcttagtgccagcaccaactgccactcacaggctggggtaatcatgggactgggagggagggatctgggtggtagagcttgctgcccagcaggatatggcaaggatgtccctgcagtcaggctgttgggcctt

SEQ ID NO: 6604 - DNA, 474 bp, Homo sapiens
ccccaccctgagttttcccctggttaggcaacgggcaggtgggggtggtggaaccaactctttagaaccagcaatgacaaacagatcccacttgggggaagttgatgttaagtgtcatgggtcctctggaattttctgaagctttcctgtttttttttttctccccctaaccagctcaactgatctcctgggatctctactaagatgttggcagcccggccagctggtctggccctggacgtgccttcatggtctggttatgcttcatgacctgcactgtggtcagtggtaagcagcacctgcttctagctttactgttgggtcagattttatccccactccagctctgcagtgcggctgcttcttgtttcatccatggaccctgcacgaaattgccccatgtttctgtttgtgcatcactgagaaaggaagcatgaaggacgcacaggtcaggccattccattgccctcctgg

SEQ ID NO: 6605 - DNA, 819 bp, Homo sapiens
ccctccacatttctcaggtttctgctcaaaagtcaccttttggaggggtctccacctgtcactgtgtttgtaagagctccttcagtttctttctagctcatctcactctggtaatgtctttgattaccaccaccatctgacctggtcttatgacctgttagctttcttcatcagacgtgagcaccaggatggcaggggcctcatctgtcctgttcctcctgtggcctgggtcctagcaccatgtctggtacagtgtagatgctcaagggaagtttactttgtagaaccacttacctgggagatgttactgttagtctaacctgtaccattttgtaaacctccagccattttgcagactctgatcacagtgaaacgttccatgggaacttgggccatgagaaacatccttcctaaccacgtgactgcagaaacatccttatcgcgtcctcctgggcaaaggcccaacagcctgactgcagggacatccttgccatatcctgctgggcagcaagctctaccacccagatccctccctcccagtcccatgattaccccagcctgtgagtggcagttggtgctggcactaagctggtttcctcctccccagggttttgctggcaataaagatgttgctgcagtcacgtggttaggaaggatgtttctcatggcccaagttcccatggaacgtttcactgtgatcagagtctgcaaaatggctggaggtttacgaaatggtacaggttagactaacagtaacatctcccaggtaagtggttttacaaagtaaacttcccttgagcatctacactgtaccagaca

SEQ ID NO: 6606 - DNA, 638 bp, Homo sapiens
tgttaactcattatttaattgaacatttccaaagctctggaaaggcatgcatttgtaggtgcacatgctttaagatttctatccatctttcagagttgaatgtaataatgtttggtatttaattcttgataattcttaaccaacttttcctgttacaggagagaaagaattgcaaatgccaggcatctgtccactttagccctcctccaatgctaagaaagagggatggtgacgtatactacagagacgcaaatgaaacaccaaacagtcttgaattacaagaaaaaaaggggattttttttttttctaatttcagacttggctttttacttagaggacattctgatttgctctcagaaacatctgatttggggttaaactaggcggctggaggatgtttacagctttgaggcttcaaataagtttccatatgcagggagtaactttaaacaatgtttgaataattaactgctaagtcttatattttatgtgtatctatttcatcctctgtctctttcttactagaataccatataagaatattttctctgcagtatttatatttatactattttgctatgagtggcctttgtattttattatatgcattaaatagtgtgtgcacaactttatcttaa

SEQ ID NO: 6607 - DNA, 423 bp, Homo sapiens
aagagtaaataagggagaggaatcattcatatacccaatgtttacccatgatatactttgtgccaggccaagtgattgctagatgcactgcaaaatatgtctgagacctgggacattgtacgtggtctgtcagaattagcccctctcttcatacatgttctgttcccttacagagtttatagtagtatgatacgtctgtgtaacaggccaacaaaaaggagacagagaaagcacacaaatttagcataatttatcctacctcccggctgtttgaagctattaacataggtgtatatagccctatatacctatgtaagccccaagcatcagtttactgtatctttgtgctatgatttatgtttattatgactgttagccatcaaataaagattaaattatgttcaatatagcttgttagtgaaa

SEQ ID NO: 6608 - DNA, 465 bp, Homo sapiens
aaaaaagaataccatggtagcacagtcataccctttaatggctcacattgttcaaacagcatgatattaacttttttttaaaatcaaagcacaaatgcttcatgcatataacttaaagagttttagatattttaagttagaaatgccaaaaatataaaaaccatgaagaaaaatttctatagaagttaggaaattaaaaatcgatcataagggaagcatctcaggtttttattgcagtatttggagatgaaaaatgactttctattgacacgatttgttatttcagcaaaatagaagtctgtcagtctaatgttggatgatctgatagtctttgcaagaaataattgcagagagtttctgcaatcactgggaaatagaaatctataaaaacatctgaaaaagtgtgagactgggccactgcctagggggatagccctgttatttctatggaacaggaaaaaaaaa

SEQ ID NO: 6609 - DNA, 392 bp, Homo sapiens
accatgttgaccaggctggtctcaaactcctggcctcaagggatccacctgtctcgatctccccaaagtgctgggattacaggtatgagccaggacccctggcctagttactatgttttaaatagctccagcccccaacacggtggttcagatttcagttaggacagtttattaactgtgcaatttcataaagcacaaagtttgcttctagcttgttataccacaaatcactttataaataacagacgtgcatcacgatctctaaccagtcattctcttcctcttaaagcctgttggtgactggtcactaacatctgctcttcagtttatacacagacagcaaggcgtgtagttgtgttgcctgtctcccagtaataaacccatgtgatatt

SEQ ID NO: 6610 - DNA, 485 bp, Homo sapiens
aactcttgtgtttctttgaattgatgatgctttatgggttttgttatacttgaggaggaaggctctaagtatagaagtattttaagccggaaggtactctcaaggtcattttgtccacttctttcactttatgaagaaatcggggacccacagaaatttgaaaccttgcctctgatgacacagccagccagggctatagtgggtgcctctgaccccttaagagagagcgctcagccttttgggactgtgcaccaccacgagcctgattattggttctttctccaggctcatgcttcgtactcatgcgttccaattaaaattggaaaggcaggaacaactttgtaccatagtgtcaggtttctctgcgaacaaatattctaacagtcctgtctcctcagtgactgtgttctcttgccattccttcctgttctgcccctttaataaagatctgttttgatttttctgggtaaacaaaaacctcacac

SEQ ID NO: 6611 - DNA, 452 bp, Homo sapiens
attttaagtaagattaggaatagtgctctgtgtagcccaaacccaaaaagcccatatagtatgggggaaatgactcacaataaggagcctgtgccctttgacattaggtagagatagttggtgtaaagctaagagcaaggatttggaatgcggtgagtctaagcctaaaccccagttccactgtggtaaaccctggatgggttacttagagtcccaaaacttctgtatgtaaaatagaaaccatcactgacatgtggtggtgtgaggatttagtgagatgatgtgcccaaaacacctaaacagtgccttagcacccagttggcatttaaagaggagaccaggaacttgtccaagaaggtccatttgcttgagatgttatatttgattcctttatcctaacaactacaaaattgttggtttgagaaagagacctcattttacaagaaaaaaaa

SEQ ID NO: 6612 - DNA, 392 bp, Homo sapiens
gtatctcccttcccaactgagtctttcccttcagcttgaaattatgaacaaatattctccacactgacaagtcctgtgttttctcactgtcaaaatagtattccatattcttctttccctttgcccttcccacttgaacttctcatttactcattagcctatggtaatatgccttctacctcttctattactctgaagttgcctccgtaaaggacaccaaggatggacttgccaaatttattggcatcttttttttttttttggagacagggtctcactgtgttgcctaggctggagtgcagtggcaccattatggctcactacagcctcaacctcccaggctcaagtgatcctcccaccacagcctcctcagtagctgggactacaggcgt

SEQ ID NO: 6613 - DNA, 291 bp, Homo sapiens
gatcatttttcttttctttctttcgtgtgtgtcagtgaagatcaccacagcatacagcacaccctgtatgtttatgggtgctgaggtggcagcaattttacctgcctctgcttctaaaccacagaagcaaatgtcagcactgagcaaaaaacatgtcagtgttcttgtgaaaatagctttgaattcacaaaggccctaaaggttcttagagacaccccctcccaagggtccatggaccacacctgcaagccactgctccggctgcctcttcccatgcatcacagaaccctc

SEQ ID NO: 6614 - DNA, 534 bp, Homo sapiens
ctgagccaattatccgtgaagcatccataatctacctactgacttgcacatccactcactcttggtaactaaagtgcttccctttctaaagaaaaccactggggaagccaaaagcatcagctaagatagataactgtgagcatgatcgtttaggaatggatatggtttgaacttattcatgtttagagagagtgtcaaattgagaactaggcagattcacctactctacaaatgactctgaagcaaattggttgaagaaattagatctgaaagattcttggtggagaattttgaacttttatcagtatatccatatttaaaaggagataaaagaagacaaaataaaaaaaattattgcaaggctgacagaacagttggattaaacatcagttcaattaaaaaggactaacagataaatcttttgaagataaattttgactccagttctttagagaaactaaggtgaccttgatgggcagtggaaagaatcatgacatgtgaaattccttgaataaaaatttattgactttaagt

SEQ ID NO: 6615 - DNA, 327 bp, Homo sapiens
gaaacaaaagttacttaaaaaaataaatcctggtgaaaccctgtctctacaaaaatacaaaaattagcggggcatgatggcgggtgcctataatcccagctattcaggaggctgaggcaggagaattgcttgaacctgggaggcagaggttgcagtgagctgagatcatgccaatgcactctagcctgggcgacagagtgaaactcagtaaatccataatagcattggattttgagaagggtgccatcaacaaactgagatagtggggacatttataaaaaatataaatcaaatggtatctgattgattggaaagccatgagaacag

SEQ ID NO: 6616 - DNA, 511 bp, Homo sapiens
ggaggtagtgtctacagagctacaagctcagatatgattatgccatgcccccgcttaaaaccctttggtgggtccctcaggatagtatccaaatgtctaagcatgctatttataaagatggttctgccttctagccttatgcttcacctacctattctcattgctttccctctctattacctatttccctacatgaacttttgcagatccaggactttgttgtctgtctgaaatactttcatttggttgttcctccagatcactctccgcccctctatatctgtgcctctggagactgaccttcgtggactgccttttccaggctttgcttctcatttgagtttggcctatgagaggcataggcaggagatttagagggtgagaggaaagtatagttaggatattgtttgcctggcttcttcctgccaggatgcagttggtgtgccatctttttcctgccaagaccttgactaatataaccactcatcttccaatacactcatttgcacac

SEQ ID NO: 6617 - DNA, 613 bp, Homo sapiens
taagatgaattaatttgattacaggacatgctaaatttgaggtggacacaccacaaaacatacagactgaggtgtgttgcttttaatcatagataaattttagaatcgaacttttgaggcattgacttaaagggtaaaattgaatttgttagagttgatagagacagggaaaagagaaacctgaggaaaaggatatagtacttcaggtaatttttgttgtctttgttgttgtttacatttaaaacattttttttccctggcaaccttcatttaactcaaagctttaggtaatgttaaaggatatggaacaggaggagggaatacaaatctttaaaccaagtcataaggaacagtgaaggatagttatgaaaaggattgagacagtgtagttgcagaaaccacgggaaatatggtggatttggttagcatgggtcagtagtgtgatggaaaagtcaaaaagttttgaaaagctgagagaaaaactttgaattaggcaaatggtaagcttgaggaggacagcttaatttgaatgatggccttaaacaccaggttgatgaagtttaggagatgatgaggtaagaataaattcagttgcatctcagatttggcaaaa

SEQ ID NO: 6618 - DNA, 471 bp, Homo sapiens
gattcttctctggagaaacaaaagcagccccaggaaaaaaaaaaaagatatttgtatttgagaaccccaacaaaatgtccagatatctacataatcatcctaccatgaagtccagtggtttagaaaggcatattgatgcacacagagcttccggtcagcctttcaatgctctattcttaaatgtcagtggatagacctccaaaacagagaaaaaaggaactcaatggaaaatgtagactttcttaatatgctcagagattgtggaaaatacagtatttctaaaataaggacagaagaaaaaaaaagtaacctgtaatcccagccacttgggagactgaggcaagaggatgacttgagcccaggaggtggagaccagcctggacaacatagcgagactctgtctccaaaaattaaaaaaaaaaaagtaaaggaaacttatatggcatgatctgtagaatatattggtaagtg

SEQ ID NO: 6619 - DNA, 260 bp, Homo sapiens
tttttttaaggcttttgctgcaagtacgagaaacaccaagagaggctgggagaaaggaaaacaccaatacgtctgggaaagcttatgaaaccaaattttaatagacaatctataacctatgtttcatactttcagggatgataataaattttgaagttttctcagaaactttttttttcttttggagacaaagtctcactcactgtcacccaggctggagtgcagtggcacgatctcagctcagggcaatttccaactcc

SEQ ID NO: 6620 - DNA, 758 bp, Homo sapiens
acttttcgctgcaagttgctacattcctgcacactcccggcccgcggcgcctctcccggcccgaagcgtgccccgtattctgccccgcgaaccgcaaacgatgggtccaatccgggtccgaactgtggtgtctgcggagaacgcgggcgcccttggctgcaggaagttcttccgctccgctcggccccttttccccgcccgtgctcgggaaaggcgcttccagttcgcctggacctgcgaaagggccaaggccgaaagaagtggagagaggatgtgcgaacccacctcctcctcctcgcgttaccccggcttgaccgagcggagcgcctgtgcgagcttaaagccgcgaggatagattggagttaaaatagataccgtgagccggcattgatgttaataaagatccattgttttcagcattaactttattttgtaattgtttcacttatctgttagtctgcaaaaactcacttgagaggggtaaacggttactgtaattgaagctttgagaccaggtctgtaactcagtgtaacttattaaaagaaacaaaaacactacattttccaaatagtgaaatcacatcaacttttttagtactcgaatttgcaatagtcactggaagccgcaacccaaaaaattagtgcgtcttcaggtacaagcattcatgcctctgtacctgtctttcatcctcaaggagctgggtccctacccctgctatccctgtgcctggcccaacggtggactccgttaatgtgga

SEQ ID NO: 6621 - DNA, 257 bp, Homo sapiens
taaattaaaaatgaacattcattaagttttactggatagtatcccattatatagtttacttattccccaaatgatagaaaaactggtttattttagtttttactattataaaattatatatataatataataatatataatatattattatatatataatataataatatataatatattattatatataattagtttttactaatataaaattattgcaattctgcaataaatatatttacacatgacattgtgaa

SEQ ID NO: 6622 - DNA, 767 bp, Homo sapiens
gcaaaagattcttaaagatccaccgactgtcatgttccacaagcaagatctcagggtagggaaaaaccagtgaatgaggttacacagcaggaaaagaaccggtttcctcccagactatgtcttacacgctgagttatgccacaagcgttatcatcaaaactatttaaggctggagtcttagacctctaaaaatagacaggaagggctgccctgagcagtgacacctttgtgtttttatgtctccgccagcgccgtaacagagcctgtttctttcccgttgagtattacttaaattcaggcttaaatgtgctatgaagggcatttttcatagtatcccatttgccttgtaagttatataaagtgcatgattataattttttccttagaaatgcaatatttagtttcatccagctcttatgaataataacctcatagattcctgatcttaatttaaataggtgctttaattttacagctttcaaaagtagttactgtaaattttactcctgttaatgctggattggtttaaaggatttataagggctgtgtttgctctttacaaggcaagatgccatacagtgttcaataatagaaggtcttgatacaaccgacattttaaatattctttatacatgaggactgcgtctttttcactgaccctatgatttcactgtgagtagggtgaactggactgcatattagtttatttgttgccataatcacatttttgaaaaataaatttaagagttttttcttaaaaaagcttg

SEQ ID NO: 6623 - DNA, 478 bp, Homo sapiens
acttctcaccctgacatcttcctcatctggttgtaacctcagcccaactctcattccagcctctgctgtgaccagttctttgtaggtacagctcctcagcaccttgaccccagccctctctgatgtctgccaggacctctaggtgctcacacaggagaaatccggaagtacaggggcccttgccaaatgggagatggaatcatggaaaagtcttcacccctccagggaaaagcagacagctcctaaatccatttcttagggctccttgcttccctcccctgccttcctctccctgctcctgacttctgctccctggcatcatttctcacataagctacctgcagcagcccctctcacgctgtgtctcagggaaaccccagccaagacaaatcatttcacgcagtaaaatttaatgaccatagttttagaatcaacaaacaggacacggcatcttacaaaagatgtttcgtccatttct

SEQ ID NO: 6624 - DNA, 291 bp, Homo sapiens
ggaacacagagagagaaaggagtagtgaatgtatttaaagaaataatgacagaaaacattcataaactagggacagatataaatgtccacacataggaagctcaaaggtctccagttatgttcagctgaaacaatgctacaataagacttagtaaaactctcagaagcgttaagacaaagagaggatcctgaaagcagcaagagaaaagaagcaaatctcatacgagagaactccattatggctatcattagatttttcaacagaaaccctgcaggtcagggatagagtga

SEQ ID NO: 6625 - DNA, 462 bp, Homo sapiens
aatgtctgctcttttgagggatatttcattatttgacaacctcaatgagaacatgtttatggttttggattactttaggcacctagtgtttctaaatcgtctatcattcttttctgtttttcaaaagcagagatggccagagtctcaacaaactgtatcttcaagtctttgtgaaattctttgcatgtggcagattattggatgtagtttcctttaactagcatataaatctggtgtgtttcagataaatgaacagcaaaatgtggtggaattaccatttggaacattgtgaatgaaaaattgtgtctctagattatgtaacaaataactatttcctaaccattgatctttggatttttataatcctactcacaaatgactagcttctcctcttgtattttgaagcagtgtgggtgctggattgataaaaaaaaaaatgaaggatgacctttcctgaacaga

SEQ ID NO: 6626 - DNA, 475 bp, Homo sapiens
tcctgccttcagctgctcctggctgcagagaagtcatcatattgacctgttgctcagtaatgccctgttctgtggtcagctgctcccaagtcacctatggccctggacagagcctcccctgcctgtcagaatcccctgtttgattcttcatttccccagtaccaatttcctgagctcctctggtatacctgatatttggtggcattcccagaaacatggggtacagacccatccctctggaagctgagcctctgatgtatgtctctgatgtatgtgcatgtagggggatggggggaagcaggatgatcacatgtgcaccacccaggagcttgcaggggccctccccaaactcactgaatcagaatctacaccttacaactttcccaggtgatgtacacgcacattaccgttggtgagacactgccctggaacacttgtttaataaatatttgttgactgatggttaaccttcatc

SEQ ID NO: 6627 - DNA, 489 bp, Homo sapiens
ggcatcttccttctggtttgtacatctagtatttagtctatatactaagtaaacattaccatctctttctttggattcagatgaaccctcaaattatttatcagcttagcacctatttatgtttttgcaagggcacaaatacattgcattgccaacagctgagaagcaccagctaaaaccttcagagtgtgcagcagctcaacaggaaatacatccttttctggttgaaatatttttaccatgatgttttgacaaaacaacgagcaattacgatgatgacatatacttatatttcagctagaattacacacaaatctacaaaccaaaacagaataaaaacaagtataagctctggctgtacacaggcacaacaaaacatttgggctgtctacttgaaaacagatactttaatatattaactctgccctgcaatgtttactcacggcctctattccgcattctcatcgccagtcccaggtactccagact

SEQ ID NO: 6628 - DNA, 550 bp, Homo sapiens
aatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgag

SEQ ID NO: 6629 - DNA, 380 bp, Homo sapiens
cagagagctgttaccgttgatctctggagcctccctgaaggccaggtggggcaggtgttctcatgctcctgccagggaaattggccatcagagacacagagtatcttgcttagggtcccacagcccccagcagcagggactggaaccagagactggctgctcctgctccccagcagttccttcctgcacatcaggggcttctccacctgattcaagcgacaggaaccccctgtgcatcttcatcctcctgctggctcagcctgccctaaacagatgtgacctgggccaggagtgcatgaaggcaggccctgttgtcctgcatgccgccagctggactggtggcccttccgtgtttgtcagcgtggtgatgaggagagctc

SEQ ID NO: 6630 - DNA, 1197 bp, Homo sapiens
aagtgacagcggtagagaaccaggcagcccagaaaccccaggcgtggagatggatcctgcgagagaagggggttcatcatggcggatgacctaaagcgacttcttgtataaaagaggttaccaagtgttgaagggctccatgccattgttgtgtcagatagaggtggagtacctgttattatactgacaaatgacaatagttggaccccacagcaatcattacttttgtagacagcaaagttatgctccttggcttcaggtgaagacccccagatccaggccagtggatttacaagtgagagtcagcagcactgggcatttcaggcaatagctctgaacaagccctttaccatgcgggtaggtaaaccccagaatatacagatgccccttacgatacatgggtggggagggtatgtggccgagagagcataagcttaggagacagagtggatttgaattccactgagcttttggctgtggacccatggggacgtggcatatgtctcgctgagccttagtttcctcctgcatggaatagggagagcaatagtacctgcctcattcagctaacgtgaggatctagagcagcatttgcataaatgacgcgtggggcacagagcagactcaacacagagcagcttacgttatgaggcttggcaggctgggagctcctgtcggcctctctcctcagctctgtgcccactgagctcggcacaagggttggcccatgacaggtgtttattatgtggaaataaatgagagggacaagacatttgctgatttcttcactgtttccaactgggaattcaaatgtatctcacgttcccataccctcacaataaatctgttcaggagaaaaatgtgtacgccttttaacagacagcactgagatatacagaaagtaagaactttcaggctgggcgcggtggctcacgcctgtaatcccagcactttgggaggctgaggcgggtggatcacgaggtcaggagatcgagaccatcctggctaacacagtgaaaccccgtctctactaaaaatacaaaaattagccaggtgtggtggcgggcacctgtagtcccagctactcaggaggctgaggcaggagaatggcgtgaacctggaaggcggagcttgcagtgagccaagatcgcgccactgcactccagcctgggcgacagagcaaaactccgtctcaaa

SEQ ID NO: 6631 - DNA, 856 bp, Homo sapiens
aagtgacagcggtagagaaccaggcagcccagaaaccccaggcgtggagatggatcctgcgagagaagggggttcatcatggcggatgacctaaagcgacttcttgtataaaagaggttaccaagtgttgaagggctccatgccattgttgtgtcagatagaggtggagtacctgttattatactgacaaatgacaatagttggaccccacagcaatcattacttttgtagacagcaaagttatgctccttggcttcaggtgaagacccccagatccaggccagtggatttacaagtgagagtcagcagcactgggcatttcaggcaatagctctgaacaagccctttaccatgcgggtaggtaaaccccagaatatacagatgccccttacgatacatgggtggggagggtatgtggccgagagagcataagcttaggagacagagtggatttgaattccactgagcttttggctgtggacccatggggacgtggcatatgtctcgctgagccttagtttcctcctgcatggaatagggagagcaatagtacctgcctcattcagctaacgtgaggatctagagcagcatttgcataaatgacgcgtggggcacagagcagactcaacacagagcagcttacgttatgaggcttggcaggctgggagctcctgtcggcctctctcctcagctctgtgcccactgagctcggcacaagggttggcccatgacaggtgtttattatgtggaaataaatgagagggacaagacatttgctgatttcttcactgtttccaactgggaattcaaatgtatctcacgttcccataccctcacaataaatctgttcaggaga

SEQ ID NO: 6632 - DNA, 490 bp, Homo sapiens
  misc_feature (362)..(362): n is a, c, g, or t
  misc_feature (412)..(412): n is a, c, g, or t
  misc_feature (430)..(430): n is a, c, g, or t
  misc_feature (453)..(453): n is a, c, g, or t
  misc_feature (463)..(463): n is a, c, g, or t
gttcctggaggacccaggcctgaccaagtccccggcctcagcaggcgatcatgttggcaggcttggatcttctcgctctgtgaccagcctgggccacacactggtggaatctgctctcacgaggccttccctgcccagtccccacaggacctcacctagggtggaggagagcaacagcaagctcctggagtcagagaggaagctgcaggaggagcgacaccgcaccgtggtgctggagcaacatctggagaagatacgcctggagccagggaaggcatcagcctcccagagagcagctcccaggaccaaaacagctccgttcctgggatgtatgctgtgttacggggccttggctgttgatngggcacaatggggccttgggtaacctgttgctgttgttttggtcactgtnttgggcctttatgttggncttgtttttttggggccagcctnggttctggtntttgggctttggtttggccagcttggg

SEQ ID NO: 6633 - DNA, 614 bp, Homo sapiens
ggcctcccaaagtgctgggattacaagcttgtaatcctggcccacacatttaatagtaaacacttcagattttcagacatgagataatctaatcaacgatacttattagccactggcctattcagcattgattctttagagtcatacaacttacactcccagttcacccaccttgggtgaggccaataattagactcaggtagcttcaagactgaatgaagtggggcaacacttctggatcattaaggatctgctgaccttgattaagaatctgataatgaggaacatcttaacccacctgtgacccacctagataaaatggataaacccatgtaacctggtagctgaactcgggaaataaaacttccaagaatcactgggaaatttaccagtgcatcctcaaaacttccataaagtatggtttcaaagaggaactgaacaccttaaagaagctgtgaagacaattaggtgagatagtattccatcagacaatcatttaatacccatacattgtattaaggatactgtgttagaattattgtggaaaattacacaacagatgtttgggttttttgtttttgtttttgtttgacacggagtcttgctttgtcacc

SEQ ID NO: 6634 - DNA, 1037 bp, Homo sapiens
tccctaagggcccgctcccgccccggctccgtttctgtctctctgaggaagcccggcgcagcctaaccctcacagggccgcggagagggcgcgccaggcggggatttgcgccaggcccgcggcgcatgctcagtggttggggactgggcgggtaccccgggcggggagcctgactgaacggcggctctgctgattggtcgggctgctcacgccacgcccgttgccttccgatggacagttccttacctgccgggtcggcctccgcagagagtggtggtcttgaaaacccagttttgggagaatacctgccgcgcctcccgcccaaatacccagaggtttcatagccgccatcgctgcggtggaggaggccgcctgttgcgtcccaccccaccagaaagcctaacactggcctgaagcgtaatcttaaagtggtaggggaaaataccgatctagcgcagagagcaaaacacctccgttctgggtttaatgggcaggtctggaggtgaggtatgccgtccgcactcaataattacttgcaggatcggattgtttctccagtgggtggggactgcaggatgtagcattgagtgagcctggcagattgaaagataaaacaagggtgatgataaaaacaattacacactaacccatttcctcctccgtgaaatgagggaatggcccagacattttccagacctcttctgtcctaagagtggagctgggtgacagagcaggtgcaagccggcctttccctgcctccccggggaacgcactctgttcggtgagagcaactcagctcgcattgactcctttcagctgcaggagtgtggccgttcagttctcatttgaactgttgacaacagttgtcttctgagaatcatgagttagagcctccctttaggcttctgactccctcaaaagtaccagacaacacaaacttttcccctcttgttaccttggctctctaagctgtatctacttctatacaaggcgaacaattttgtctttttaaattaaaaacaacaacaaaagcaaaa

SEQ ID NO: 6635 - DNA, 1704 bp, Homo sapiens
agcggatgtgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgcttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatgaaaaaaaa

SEQ ID NO: 6636 - DNA, 1544 bp, Homo sapiens
gggtacctgggggcgcgtggagacaaggaatggagcccggaatgccgggcccttgggtacttgggaaggcaggctgctgagtgcctgggatggggcgatcttcctccccagaagcaaacaaacctccccgcgagaatctgaatgcgttggcatcttgggtggtgactgaatggtcagatcgtggactagggatgcttctccaagctctaagaggaccatagtctgctctcttctctggcacccgcttgcttctacgctccttcacctctgcagccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatgaaaaaaaa

SEQ ID NO: 6637 - DNA, 1700 bp, Homo sapiens
agcggaaacgcagagctaggaggtgtgggcctcgggtgaggggagacccagctcttagacctgggagcccagacagaggtggatctgcccaccttgcagctcccagaggactcctgctgccttgtaccagttgggaaaagcaaaattcagagcagttcctttttctgggtccctcgccttggccacatcagaggaaacgtcgactcgccagggctcccgggagaaatcccgaggtcagtccctcccattctggggcacccctggagcagctagctccctgcctagcggtggcaaactccagagccccaaggagcagaacggggattccctgtgcgcaggctcctggtgcagctcctgagcacaaaggccacaccctcacagaccaggcctggtgagagagccgggcttcttcagaagtacctggatacctgaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatgaaaaaaaa

SEQ ID NO: 6638 - DNA, 375 bp, Homo sapiens
cacaaaagagttaattgatgaaggaatctgaaggacactgagcaagcccaccccacccaggcttgatggatagatagggcggattagaagccactgggggccagacatggtggcttatgcctctaatcccagcacttggggaggccaaggcaggcacatcgcttgagctcaggagtttaagaccagtctgggcaacatggcgagaccctgtttttactgaaaatacaaaaaattatctgggcctggtggcgtgtgcctgtagtcccagctacttggggaggctgaggtgggaggatcacttgagccagaggttgaagtgagctgagatcacaccactgcactctagcctggataacagagtgagaccatgtctta

SEQ ID NO: 6639 - DNA, 446 bp, Homo sapiens
ttaagaaccagtgcctcacattcagccctgacagcagagccccctgccactgacagtcatgggacctcagccaagttcttcagccatcttgaatctcagtttcctcttctgcaaaacaagattaataataatttctactattattatatatattccatgagaacggaatgtgacagcttagttaagctgtcaagctaagttaagcttagtttaacctggtatccagttttgagaaagccctcactgtatagtattattatcctgttctctaaaccctgataaatgtataatacatgagtttgcttttgtactttaaaagcaaaacctaatcactgggcactgtagtgcatgcctgtgatcccagctattcagaaagctggagcgagaggattgcttgaagccaggagtttgagactaacctcagcaacatagcaagaccccgttcc

SEQ ID NO: 6640 - DNA, 535 bp, Homo sapiens
agatgtcagaaaagagtcagaaagcccaggtgatagaataagtgccaagaacatatacaccatggaatactgtgcagccataaaaaggaatgagttcatgtcctttgcagggacatggatgaagctggaaaccatcattctcagcaaactaacacagcaacagaaaaccaaacaccgcatgttctcactcataagtgggagttgaacaatgagaacacatggacacagattggtaaaacttcagcggttggatgacaccctcttttggtgatgccgtgggggaacgcaacatgattcaaccccaatgaaagagaagttgcaataaccgctaagactgcagatgcatttgactcagcaaacccccttcaagaaatgcatatgaaaaaaactcatgtttcaggttattcattacaacattgtttgtaatagcaaaatgtggattagaaatagtccagatgtctgtccgtaggggactgtttaataaactattgtcagtcccttagtggaaagtaattattttctcagtgaataaagg

SEQ ID NO: 6641 - DNA, 405 bp, Homo sapiens
gaaaatgatcaaaacaaatgacagggctcagggcaaggggcaaaactgttcccctgccaggctgtttgatagaaaaaggaatggttttcttagttctaaagcttcaaccacactggatccttgtgttttcacaacccttaaggttagagccaactttcaaaaagaataattaaatcgggaaataagtggggtcagcaggtttcgtagtgcttttaaacaggaagtctcagaactcatggagggaagtagctgacagcaaaactgctttcctactcatcaacccaaagaactgcttaattccagaagaagatagaggagcacatctcaccaaagacaagttgaccctaactcttaaatcatctacagccaaaaaactgattctgtacctggttgatcatgcctgta

SEQ ID NO: 6642 - DNA, 323 bp, Homo sapiens
ctttttcctccattcctccttctttctctctcttcctccattttttcctttttattatgaaattttcctaatatataaaataactctatgtgattgggctgtaagtaagcattttctgaatctatatgtcaaaaatataatgtcataataaaaaggaaaaaatggaggacgagagagagaagaaggcggaatggaaggagacagcaacagtgcgagaaagagacgaaggggagcgcggacacaaagggagcaagaaggaaggacgcacgaaagagtcacaggaaatcgcgaatccagacaggtgaccgggcaccgcactggag

SEQ ID NO: 6643 - DNA, 218 bp, Homo sapiens
ctttttcctccattcctccttctttctctctcttcctccattttttcctttttattatgaaattttcctaatatataaaataactctatgtgattgggctgtaagtaagcattttctgaatctatatgtcaaaaatataatgtcatgtatatgagaaacaagtaaacaacaggaagttattaacagagtctgaataaaaatgcctgctataattctac

SEQ ID NO: 6644 - DNA, 526 bp, Homo sapiens
  misc_feature (17)..(17): n is a, c, g, or t
atatgccgcagtctccnggagcagtccacgctcggcccctactcggcccctccccagctacagcagctccagcctctacgcccctgatgctgtggccagctctggacccatcatctccgacatcaccgactgctcctgccagccccatggcctcccccggcgggagcatagacgagaggcccctatccagcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 6645 - DNA, 1506 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 6646 - DNA, 2414 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgcaaaaaaaaaaaaaaaaaaaaaaaaaaaaaaaaaaaaaaaaaaaaaaaaaaaaccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcccccccctctgttggggaggggtagccatgatttgtcccagcctggggctccctctctggtttcctatttgcagttacttgaataaaaaaaatatccttttctgg

SEQ ID NO: 6647 - DNA, 1198 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 6648 - DNA, 1327 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgctattaaaggggaatgttactgca

SEQ ID NO: 6649 - DNA, 1163 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggccagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 6650 - DNA, 1029 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgtt

SEQ ID NO: 6651 - DNA, 823 bp, Homo sapiens
gtgagtcccaggcgggcagggatggctccctggacagaggaggcagcagctgaggcccttccaggcacctacccatctctcttttcttttcctggagccaggtgggccagggttacccgcatgatccccccaaggtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtttcttgatttcccagtcatcttcctcatggcctgaccttggttttctccttggcctgtcctgctccacaccctccctcccagcctctcacatgctcactctcctatgccctggatctgacctgcccaacaccagaggggcctgtggcagtctcccactcaccaagccctgaccctgatgctctctgtccacagagaggactggaagccagtccttacgataaactccataatttatggcctgcagtatctcttcttggtgagtaggaataggtggttgggtctggggagattggccttctgtccctctggcctgttgaccccccctacctgtactggccacaggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccc

SEQ ID NO: 6652 - DNA, 2106 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgcaaaaaaaaaaaaaaaaaaaaaaaaaaaaaaaaaaaaaaaaaaaaaaaaaaaaccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccgaatcgaccataaagggtgtaggggccacctcccccccctctgttggggaggggtagccatgatttgtcccagcctggggctccctctctggtttcctatttgcagttacttgaataaaaaaaatatccttttctgg

SEQ ID NO: 6653 - DNA, 1686 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgcatggcctctgcttcttacttctatggggtgggaggggcagctgaggtccattagggcctgcaaagctggggtggtggaaggtgtggtcacaggtggcattggagcaccctacaacaggctgcccagtgcctggggcagctctaaagttggtggggataccatgactgtgcctggggttggt

SEQ ID NO: 6654 - DNA, 1266 bp, Homo sapiens
taagaggatcccctgttagaggttgtggcgctgtagagttggtggcaggattgtaggtggatccatagttagctgccaaaactaaacaaagaataaaataaccattagaatgtcagaataatactttggtggcccatagaagttctggattatttagtaactcaataaacaattgtagtttatgtttagttattctaatatatttaagtttctttatttccctaagtagacaatattatgatttcttcagaaactatcaaaaaacacttttgatcatacttcaagccaaatcaactgacctgccacaacccttgtagaggtggtggcgggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 6655 - DNA, 1207 bp, Homo sapiens
ggggtgcctgcgctggtgggcgcgtgagaggatgctggatgctgtgctgcggtagtgccgggcgggtggttgtgcagcatgctggaggatggcctgcagctgctgggtcctgagtgatgctggagtgctgacgtgctggtgctgtgctgtgctgtgtggtgtgcctgtggtgtgcctgtgggatccctgtggcccctgatggcgggctgtggcatgctggctggctggatggctgtgcagtgatgatcacacgcttgttctctgctttgaatgcatgcagacatgaacgggcaggacggcagtctggctgtgtgctggtgcacccaatgtgtgcgatgcatgcaatgaatggctgtcggcgggcgcagcttgcttgatccatgaaggacataaacgagctgaacctgcccaagacgtgtgatatcagcttctcagatccagacgacctcctcaacttcaagctggtcatctgtcctgatgagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcagagaggactggaagccagtccttacgataaactccataatttatggcctgcagtatctcttcttggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgca

SEQ ID NO: 6656 - DNA, 1161 bp, Homo sapiens
agcgggggagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaaggacataaacgagctgaacctgcccaagacgtgtgatatcagcttctcagatccagacgacctcctcaacttcaagctggtcatctgtcctgatgaggtgagggtgcatatggctgaattcccaggagcaaaccaagggtgtccccactgagaggagggagacatgttctgcccatcgggccccacaggatggaaccctaaaattttcttctcccccttttcctcccagggcttctacaagagtgggaagtttgtgttcagttttaaggtgggccagggttacccgcatgatccccccaaggtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgtt

SEQ ID NO: 6657 - DNA, 2058 bp, Homo sapiens
gagatttttacaaaaagaaatactataggccataaggttgggggaagaccccaattaatggaaatggcctaagggaccaatgcctaattaaatccgttaaccagtgattttgtccaccataattacatgacttatagcctaaaagagcaatatttaatccagtaagatttagagatgggtgtacttggaatccctttgaaagcagcgtgtttagttttcaagcaaatgctaatgttccttaatccctaatagtatattagacttcgttgtgttgaatatatcaaatgaacgaactatgaaccagagctttaaaatagtgatttgtaagactttgttacaatggtacttaaaaaattgctttgtataatttacacactgtaaaattcacccattgtacatgtacaattaattgtttttagtaaacttaagagttgtgcagtccaattttagaacatgtccatcagcccccaaaatttactcctgctgctctgcggttaatttgctcctgcctccagccccacgcagccacactgatctgctttctgtacagatttaccctttctagaaatttcacagaggtagaatcatgcagttagtcttttatatctgggcatctttcacttaggcatgtttttgaggttcatccatgttgcagcttatacctgcgtgtagttcctttagttgctgacttagtgttcactgtttgggatataccacattttgtttatcccattcaccagttgataggacattgggctgggcctacaattaggtttttttaaattgcggataataatgctatgaacattcataaatgtctttgtgtggacatgttttcatctcagattcctagttgtggaattgtcaggttgtgtggtaaatttatacctaacgtttttaaaaaaactgctgaactttttccaaagtggctgtacttctagaactattcctgccacagtgcatgcggactgccgtgtctgcacatccttgccaatacttgtcttttttattgcagccatcctggcgggtatttactttatgtgtgtgagttatacctaggcatcccaactcgtgtatcgattggatgtgcagtttgagtgagtttcaagtggcctcagcgattgctgtaaaattagttactctagtagacatgtactctcttggaggtagtattttctgtagtcagtgagggtaataataatacttccagtgggggttccagtccctcagtgatctctggtgagaagaaatgtgtcagcgaagagtggtgctgatggctggtgctttggctctgttattgtttgtaccaaggttgatacagctactcgactagcctatgactgactggtggtggtaattaaactttgtacagattactgtgtgcagatagttactgtcttaatattaagtttcccagagattttacttttgagatagctgagaattaacgactcttggaatttataaaaatttagttgataccatttagttgctgccagctgcctgtgttcttatacataggagacatcggagtgagtgctttttaaaaaattaatggcgtatgtcaggtatatgtaaaaggacaattgcataatgaactcatgttaacatgatcaatccatggccaatcttgatttatctaaatgccattcatctttgaacccctatttattttgaagcaaatcccagatagcaaatcatttcatttgtaaatatttcaatatgtatgtctaaaagataaggactgttaaataaaaccacaattctgttgttagacttaactgttaacagtttgttagtgttaataactacccagcagtgttcaagttgtgcctttttttttttttttccaattcaagtcaggattcaaataagattcctacattgcatacatctcaaatgtcctacccagtggatccccacactctccactctttggcttcaaattcatttttttgaaaaaacaatgattgctttagcactttaaatttctatgcaatttcaaatgtaaggtgaaattttgatgtacttaataaaaaaattctaacgaaaaaaaaa

SEQ ID NO: 6658 - DNA, 860 bp, Homo sapiens
tagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttgaatc

SEQ ID NO: 6659 - DNA, 691 bp, Homo sapiens
gaaaaacttccccgagtttcccaatttacattacaaatggagcggtggtgtaatgaagccgatataaagtgggcagttgaaaggagactaaagaagggcactcaagtgagaaatgaagaaatgtgccgagtgcagtctgtgggctgcccttggtccagctgcaggaactggctctggccagaggtagagtgagtgagcacctccctctgcaaagaccacccacttttggagcctaggctggcacaccaaagattacctcattgattaatacagggcttgaaaatttctgaggtggcaaaatcacttctaaatctcttttttgagtccttcctagagcatgactgaggccacacttcctgtgccttatgacctgaagttgtaaaggataacctatggatggaccagttcttttggttctgaggactagtgtatttcaaatgttggaatgtattcctaggtgaggaggctattaactagattaaattggttttagttatatgcttcttactttgtgtcatattttagactccaaaaactgtcttcctaccaaaaaaacccaagtattccatctgtgagtggaaagagaccaactagatgtgtctttaaccagcgaagtggtttgctcaggttgcagtgcgtggaggtgctaaagaatagcatgggccgggcgcagtggctcctgtaatccttg

SEQ ID NO: 6660 - DNA, 329 bp, Homo sapiens
  misc_feature (109)..(109): n is a, c, g, or t
gaccccagcactccgacctttggctgcgtgaacctcagcccgtcccacccaccccctgctgtctgccagcttgccacaaacttcccatctgtggatctccaggcccatnaataccagcctgtctgcgagttagacgccagtcctgctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccagagaaaaaaaaaa

SEQ ID NO: 6661 - DNA, 1267 bp, Homo sapiens
  misc_feature (84)..(84): n is a, c, g, or t
cggagtgacagccccacgggccacgcagcaagcagaagatccccgggagtcaccctcaaccctctggggccacgtgggcccatnaataccagcctgtctgcgagttagacgccagtcctggtggcccgggaagcccagatccgcatcagcggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccagagaaaaaaaaaa

SEQ ID NO: 6662 - DNA, 1311 bp, Homo sapiens
  misc_feature (84)..(84): n is a, c, g, or t
cggagtgacagccccacgggccacgcagcaagcagaagatccccgggagtcaccctcaaccctctggggccacgtgggcccatnaataccagcctgtctgcgagttagacgccagtcctggtggcccgggaagcccagatccgcatcagcggttctgcaccccacaccagcatgtgctcactgcctgtgccccgggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaccatgacctcaaccgcaccttcaccagcagcttcctcaattccaggcccaccccggacgacccatatgaggtgacaagagcccgagagctgaaccagctgctggggcccaaggcctcgggccaggcctttgactttgtccttgacctgcacaacaccacggccaacatgggcacctgcttaatcgcgaagtcctcccacgaagtctttgccatgcacctgtgccgccatctgcagctgcagtaccccgagctgtcctgccaggtcttcctgtaccagcggtctggggaggagagctacaacctggactctgtggccaaaaatggactgggtctggagctgggcccccagccacagggtgtgctgcgggctgacattttctcaaggatgaggaccctggtggccacagttctggacttcatcgaactcttcaaccagggtacggcctttcctgcctttgagatggaagcctatagacccgtgggcgtcgtggacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccagagaaaaaaaaaa

SEQ ID NO: 6663 - DNA, 820 bp, Homo sapiens
  misc_feature (84)..(84): n is a, c, g, or t
cggagtgacagccccacgggccacgcagcaagcagaagatccccgggagtcaccctcaaccctctggggccacgtgggcccatnaataccagcctgtctgcgagttagacgccagtcctggtggcccgggaagcccagatccgcatcagcggttctgcaccccacaccagcatgtgctcactgcctgtgccccgggagcccctgcgtcgcgtggctgtgactgggggcacgcatggcaacgagatgtcgggcgtctacctggcccggcactggctgcatgcccccgcagagctgcagagagccagcttctccgctgtgcctgtgctggccaacccggcagccacatccggctgccgccgctacgtggaacttcccccgcaccgaggccgggcacctggcaggcactgtgcatcctcagctgcaggaccgagacttccagccactgcagcctggtgctcccatcttccagatgttcagtggggaggacctgctctatgagggagagtccacggtgtaccccgtgttcattaacgaggctgcctactatgagaagggcgttgcctttgtccagactgagaagttcacattcaccgtgcctgccatgcccgcgctgacccctgccccgagcccagcttcctaacccaagacacacctccccaacctcagtcttcccatctgaacgatgggtcctgaggcacagctctgagcacagaggtcccttctgccacctaccatgcaccatgttccttgccaggcctccccaacccctggcctcaatttccctttctataaaatggaagatgtccagagaaaaaaaaaa

SEQ ID NO: 6664 - DNA, 425 bp, Homo sapiens
gctcttcctgcatggaaagcttggtttcactcttcagaggtggtggcaacatccccagaaaaccggtaggcgtgggcacagtggctggaggccgagggctcctcgccatagcagaagcacggccgtggcttccagcctgtaaccccatctgaagttgtctggggatttttttgccgcacattgtttttgcattttgtgggttgtcttgtttcgtcgggtcttttgcttgtttctgcctcactttcacatttggcagccagctcctaccctcagccaacagcctgctcagctccaggtcgacatgaggcgctggtgtgggaccaggcacaggcctgactctgacagacccaaaaaaaaaacaccacaccaggcagcctggccagagagggctccgagcaaaccagcatctccaggcctagcaggtt

SEQ ID NO: 6665 - DNA, 865 bp, Homo sapiens
gaagtgactgaagctcagagaggtcagatactgtgtccaatgacaagcatcagtaagtgtgaaaatgaaggttcaaggccaagtcttctgggccccaggtcctttcccttctcatagctcttgttctttcccatggattagctcagcaagtagcttcaggggcttgttttcaggatctatgagagaggaaggcatgaaaacacaaaggtggaaccaaggaagaccagagggagagaagaggctacctagatgtctcacaatagtgtgcattttgattaaatgacatacttgggggaaatgttcctgagtaggtgaaagctgatattttgttctattgggaaaaaaagtgagcttgaagaaaacataatttgcttctttttttctctcatatcagagggaagagagaagacatttatagtttctaaaataccctcagtagtataattctgtcatacttaatatgtaaatgactagatcaaggaggaagaggggcgtgactgcttttagtacaaggcagaggtcacactagtctctcctggaaaactgacctgggctccagttgtactcatggtggaaaatctcagggggccactacagtcagcagtgttaacacttttagcctcttttaattttttaaaaacaaaacacccaggaatcaattaaccaaagatgtgcaatatatgtgcaaggaaaactatcaaacactgatgaaagaacttgaagaggacataaaaaaatgaaagggtattccatgcttatggtttggaagaatcagtattgttaaaatggcaatactacccaaagcaatttacagattcaatgcaatcctctcaaaatatcaatgacattcttcacagaaatagaa

SEQ ID NO: 6666 - DNA, 1225 bp, Homo sapiens
tcttattttcttcagtgtgtatatttctttactatcattcatattgatgcccaaattgtcctaaatcaggccaatgggagctccttcaagctgatcctgtgtccttttgatatgacttaatcatccattgagtgatttctttgctgttgagcacaatcagatattccaggctcatttcaacgctggagccaggcacttctatttcttttagtggagaatagcatttggaaatcaagatctgcgtgctgggtatgttcattgctactggggtgtcattgcttctaggccttttcaactgacagggtcagtaatggagtaaaactcattgtaatcgtgtaacttatgtgggttaagaaattgaactttgctagtaccccagaagctcctttatgtcccctcctgattttaacgcttaatcaccttcatcctcagttttatggtaatcacttgtctttgcagttttagtctgtaaccatgcatccctaaataaatgtttagattgcctattttaaaaatttaatataattggttcaatgtgtgcatttcatgtatgacttcttttatgtctgtgatgttcatcagagttgtttcatttgtagttattttaatttctgtgtagtattatgtttcatgaatatattacaactttaggattcattctaatggtgatagacatttgtgttgttcatagtttttggctattaaaattgcttttataaatattctatttttatgaacctgtaagatgcaatttcaggaatattctaatcgtgtgaatattatattgctttttggtgtatattatgggctgaattgtgtcatcttcttcaaacaaggtatacagaaatcttaacccccagtaccttagaatgtgacctcatttgaaaacagggtaattgcagatgttatgggttaagatgaggccatactggagtagagtgggcctcttatctgatatgactggtgtctttataaaaggaaagctgtgtgaagagacaaagggagaatgccatgtgaagatggaggatcggagtgatgcgtctacaagccaaggaatgccaaagatttccggccagtcaccagaagctaagaggcaaagaaggattcccctacaggtttcagagaaagcatagcccatatccctgctgacactttgattttggattttcagcctccagaattttgagacaataaatttattgtttaagtcccccaaaaaaaaaaa

SEQ ID NO: 6667 - DNA, 722 bp, Homo sapiens
tcttattttcttcagtgtgtatatttctttactatcattcatattgatgcccaaattgtcctaaatcaggccaatgggagctccttcaagctgatcctgtgtccttttgatatgacttaatcatccattgagtgatttctttgctgttgagcacaatcagatattccaggctcatttcaacgctggagccaggcacttctatttcttttagtggagaatagcatttggaaatcaagatctgcgtgctgggtatgttcattgctactggggtgtcattgcttctaggccttttcaactgacagggtcagtaatggagtaaaactcattgtaatcgtgtaacttatgtgggttaagaaattgaactttgctagtaccccagaagctcctttatgtcccctcctgattttaacgcttaatcaccttcatcctcagttttatggtaatcacttgtctttgcagttttagtctgtaaccatgcatccctaaataaatgtttagattgcctattttaaaaatttaatataattggttcaatgtgtgcatttcatgtatgacttcttttatgtctgtgatgttcatcagagttgtttcatttgtagttattttaatttctgtgtagtattatgtttcatgaatatattacaactttaggattcattctaatggtgatagacatttgtgttgttcatagtttttggctattaaaattgcttttataaata

SEQ ID NO: 6668 - DNA, 441 bp, Homo sapiens
ttcctttatgtcatagtgtgtatcaatatttcattccttctatggcagtattccatggtagagacacactgcattttgtttatctgttcatcagttggtggatatttgggttgtttccatgtattccatgtattggtcattatgaataatgctgctatgaagattgttgtacaagtttttgtgtggacatttatttttctgggatatatgcctaggagtgaaattgttgcattataggatgactgtacatttagccttttgagaaactgccagactgttttctaaagtggctacaccagttgagtgcaatggctcacacctgtaatcccagctactcaggaggctcagctaggaggatggcttgagcccatgaattcaagaccagcctgggcaagatagtgaaaccctgtcttgatttttaaaaaatccaattaaaatgac

SEQ ID NO: 6669 - DNA, 780 bp, Homo sapiens
atgcccgtaaatactcaaattggaaagaaacctgtaattgcccagtggatatttcaaatacacttaactttgctatttcaagccacagacaccaaatggacacaaaggtcattcaaactgttagcgccatggacaaagatgatcccaaaaacggacattatttcttatacagtctccttccagaaatggtcaacaatccgaatttcaccatcaagaaaaatgaagggatgccgtaacaaataatcccaaactggaaagtgtaaaacaacagatgcttattctcttagagtttctggaggctggaaatctgaaatcaaggtgtgggcagggccatgctctcctcaaaaattctagaggagaatccattctctgcttaagtttcatagatcacttgatgactcctgggttttttaaagtgaatagcacagcccactctctgtccattttcactccaaaatgacaatcatgcagatatttacagaactctactgctagatggttacagtgcagaaagagcctgccaagtgatcttctgtattaaaatgttctaattcattttgtgtataattgtaaattgttgggtaaacattcagtttggtgttagtctaagaacttccacaggaatccaccatgaagttgattttttttttccaaagccaaagtggaccttgctccaatattttatggctagatataccacattctaaatatttaatatttggtaatgagtcaacactccaaaaaatggaaattattgacatcaggtggcatgacagaaaa

SEQ ID NO: 6670 - DNA, 337 bp, Homo sapiens
atgcccgtaaatactcaaattggaaagaaacctgtaattgcccagtggatatttcaaatacacttaactttgctatttcaagccacagacaccaaatggacacaaaggtcattcaaactgttagcgccatggacaaagatgatcccaaaaacggacattatttcttatacagtctccttccagaaatggtcaacaatccgaatttcaccatcaagaaaaatgaagatcagaaatccatgagttttgcttcatagaccactacttacttggcacctgaataggaaatttgaggtctccagaaaactactcttcctcagcctgaacactgtaggtaaaa

SEQ ID NO: 6671 - DNA, 3823 bp, Homo sapiens
agccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcatcaaaaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctgggctaatccttagataaatggtttaaatagaggaaaaaatcataattaaaaggtgctttcttaggaaaaaaaaatacggacctgcaagggaatctgctgctggatatgtgtcttctggcaagggatttttatggaatgcaaatgggttttttccccctttcaccaatagggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaatcctgtattgtttcctactttgtgaaatatatttttataaat

SEQ ID NO: 6672 - DNA, 2374 bp, Homo sapiens
agccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtaaatatctccatgttgttaatgctgaatatgtttgtatacaactgtctcatatttgactaacctgcattatattgtgcatttgcatcatttatgatctgcaaagtctcaggcaagaaacacatccaaatgggaacagagagggaattttttttctccatcagatgttatttctctctccctacttatgaccaaattggctcctaaagtggaacaaccctgctgtgcccacaaaccccagagcccaaatcactgtcttaaaatatccttgggatatggatgatagcaggagatgtccttagagtgacgggggctgaatttttactttcaaatgacaagaagcaaggtaaaacctcgtggagaggagacatttgtttcacagcaaacatatgaataccaaataatagtgaaacccaagaaggccagtggtttatagaaagttgtaggaagtgaatattgaaatctgtaaatatgtaaatatatttagataaacataagatgaacaacacgttttacatgtgtgtattagtagaacattttttgtgcctcatattgcatagatgggtcaatgaaaacagaaaaaaaa

SEQ ID NO: 6673 - DNA, 2135 bp, Homo sapiens
gccaaagtatcagaccacaaaaagaatgtcactaagcttttaccgatggcaggagcctctgaaatcatcagaaatgctgacgtcaagttttatgtttcaggtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcatcaaaaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagattgggatcctgggctaatccttagataaatggtttaaatagaggaaaaaatcataattaaaaggtgctttcttaggaaaaaaaaatacggacctgcaagggaatctgctgctggatatgtgtcttctggcaagggatttttatggaatgcaaatgggttttttccccctttcaccaatagggatcccgccacaaatgataaagcaatacttggtctgctgtacattataactttttggagttttgagaggcctcctagattatacagtacggtgaccacacattgtacataattgttggccccactcactagagactgaatagcatctttaaatattgtgtcgagccttaaaatattcacatgttcgtaatccattccagggtggggcttgccaattcagtggtgggaggagagaaatcccattcaaacatgcttgttttctagaagcaggattcctcgttccctcctcttcatcttcttccacaaggacacaaagataaactgtatcacacagtggactacataagagacagatggttttattgctagcgcgtgaatttatttgtttaatcctcgaaataaatattttattgatgtccattaatgcttttatttattaaggtcggtaatctatagattaaggggatatatgggaaaaaactaaattatatccattaataatcctttagattgttttatataaatatatatacaatgaatgtttaatacatgtacattttgatgagatgagtatggcaggcaatattatcgaaaggagagctaatagtctctttagagtagaaagtgttattgtaactggagatggcaggaacagcatcttcccagacaaatcctgtattgtttcctactttgtgaaatatatttttataaat

SEQ ID NO: 6674 - DNA, 1395 bp, Homo sapiens
agccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagtaagttaatttcctgcactggatgagaatcttggtatgatgtttccatttgaatttatattataatttttagtgataattaaaaacctgacagcaactattgagtggcttattatgtgccaggtatggcatgattttggtactaaacttattcccattttacagattacaaaacagttgataccatttccaaatatcaagcgtatagtaagtaagaattagaaccagtatgtctgactgcaagttgtgcactcctttctcttttgcctgctatttctctttatgaagataacacaggcccaagatga

SEQ ID NO: 6675 - DNA, 848 bp, Homo sapiens
agccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtatgtatgcttccaatttcacagatctattaaaagtcatctttagaat

SEQ ID NO: 6676 - DNA, 826 bp, Homo sapiens
caaaaaaaagaaaggaaaaacagggccaggtagccattgtggagagagcacacttaggaatcctgggatgttagtgttaaaagaaagctcctggagccagtgattctcaggtttgtcccagaacccttttttctaagccccatataaaaggtagattaaaaaaacaaagtagcatgagtgaaattgagagagggacaggtaatgccttccagcccctaacttctaacaatctggaagcacaacgtgaaaatcacgtagcccaaccctatcattttcatattatgaaactgagtccaggtaagtgaatctgtccaaggtcacccagcaaggtatcagtagccctgagggtaaggactctgataaggctcgggagggtcctggaaagcctgaggcggcaggaagagtgtgcagagttgagcgtgtctggaaggctgatccactgctgggcccacatcaaagcccccatggggagcagacccgactgcacatggctcttttgctggaagaagagcatggctgcgcagaggactaaaatttcatctgggaaggcttcttttgactgtcagtagcaggatgtcaccagatgagggtgctatgggaccacagctgtctttgttcccattgcaactcaaccctgcgggaggccgcctgcatccctgagagccttctggagcctacagaggagacattggccagccaaaaggaaaggagtggccagggtacgacctggagtagggaagggaaaaagttcccggaaagaagagaattggatgagaggtctcggtggaaataaaggttttctggcattggtcaaggaaactcgcgt

SEQ ID NO: 6677 - DNA, 374 bp, Homo sapiens
cctggcccaacggtggactccgttaatgtggactgaataagaaatgaatgggcaaggaggtcatcccaggcacctgatgtacaaggagcccttctggaagccactcaaaaacaatagaaatgttttttaagtcatacactctgggttttttttttttaaagcatccttgttgagatataatttatataccatacagtttttgcaatagttgtacatattagtatatttaagcaattcactgtttttttaaatatattcataggattgtgcaacatcagtctaattttaaatgcacaagcccattctaaggaaatctggctttcttgttttaatgattttgtctacaatgctagtgaaacaaaggtataagtagg

SEQ ID NO: 6678 - DNA, 578 bp, Homo sapiens
ggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6679 - DNA, 4023 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgtagtctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaa

SEQ ID NO: 6680 - DNA, 4081 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgccccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6681 - DNA, 3706 bp, Homo sapiens
agacatatgtcatagtacgaggccgggtggtgactttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6682 - DNA, 3536 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgaccacgttggccgaacatcggggg

SEQ ID NO: 6683 - DNA, 4166 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaagtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6684 - DNA, 3622 bp, Homo sapiens
  misc_feature (22)..(22): n is a, c, g, or t
tacatcgagctcggacctgatncaccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6685 - DNA, 3631 bp, Homo sapiens
ttaggctaggtagcgaggctgggtggtgccaacccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6686 - DNA, 4257 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggtttgactcctgtttaaagtatggccatcataaaaggggaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6687 - DNA, 3377 bp, Homo sapiens
tgtgatcatgtgttctaggtttccttcctaaagtgttttttttaaattggaacacatttcctgtgaatgttttccattttttttggtcttctgtcttgcaaattgtgtttgcagacaatggggctgcacatcattatgattacaccaagtgtcaggaaggaagcagtacattccaaagagatgggctctttattttctcaaaaaaccaatttggagttactcatttttccataacattaaatttcttacaggaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6688 - DNA, 3406 bp, Homo sapiens
  misc_feature (84)..(84): n is a, c, g, or t
  misc_feature (96)..(96): n is a, c, g, or t
  misc_feature (344)..(344): n is a, c, g, or t
ccaggtagacctaacatcgggagtttaacttccacttccatgctatcggatgtgttgggctccatgcaagaacttggaagaaanacaggcaggaangcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccggcatggtgaagccccgtctntactaaaaatacgcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6689 - DNA, 3105 bp, Homo sapiens
gcggccgcctactactactactgctcgaattcaagcttctaacgatgtacggggagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6690 - DNA, 1389 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgggatgcgggccgttccctttagagggggggtattcaagac

SEQ ID NO: 6691 - DNA, 2349 bp, Homo sapiens
tgaccctgcattgattaagcacacaaaaatcatggtcatcctgtaaagcgattggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6692 - DNA, 2095 bp, Homo sapiens
acccctcgcgaacgtgttatccatagaggagacaagttagacctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6693 - DNA, 1676 bp, Homo sapiens
tgagccggctaccctggtagactaaccatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6694 - DNA, 1595 bp, Homo sapiens
atctatgtgacataaaactggaaagcggctgggcgcgtggctcatgcctgtaatcccagcactttgggaggccaaggtgggcggatcgcctgaggtcaggagttcgagaccatcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6695 - DNA, 1647 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgtatccttttcaaggttgattatcttttttagaagtcaagaaacagtagttcattttggttttgacttgtctggatattttagtggaaagaaaaactgctctgggagtcagtccattaaatagtgctgactttagataactttctggacatttaaaataacagctattggtttaagattcttttaagtttatgaattatgactgtatgataaagtattacaaagtagtctatgggaatctgtgtccttgcctccttaaaaaaaagctccaaagagccaaagcaaacctgtcatttttgatagcttctgaaataataagcccctgtacctgttatttttgggctctgggggttgggtggatggccaatgcagttaaataggttcattccagtgtatcttaatagtgtttcaagctgctgttaagttgagcttttgggcaagaatcagtcttctcttattaatttattaaagatgttatccaggaatgtgcagccaagattttaacaattggtgattatgatgtaataaaatatcagataccctccaacgtgtacct

SEQ ID NO: 6696 - DNA, 306 bp, Homo sapiens
gcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctgtgagtgctgggagcgaggcgggttaggcaggccgccggctagtcgggctgggcggggacgtggcaggacccggcgagcagggaaggcgtgggtgccggccgggggtcggcaatctctccagctcccctgagctcggggaggcacggagcctcttctt

SEQ ID NO: 6697 - DNA, 4218 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6698 - DNA, 4192 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgccgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6699 - DNA, 4248 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaaaaaaaaaacacaagggttcccgccctcaat

SEQ ID NO: 6700 - DNA, 3567 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaccacgacgacgataccgcaggtcacggacgg

SEQ ID NO: 6701 - DNA, 3302 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttgcaggtctcgagaatttttcattattattattttttcttctctactctgaaagtgggtccgagt

SEQ ID NO: 6702 - DNA, 3625 bp, Homo sapiens
  misc_feature (5)..(5): n is a, c, g, or t
  misc_feature (7)..(7): n is a, c, g, or t
  misc_feature (11)..(11): n is a, c, g, or t
  misc_feature (18)..(18): n is a, c, g, or t
tagangngcanattgggnacgaggggtccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6703 - DNA, 3753 bp, Homo sapiens
actcaacagcacaccacccagccgtcctccccaggtgaaaacagctactattgccactgaaaggaatgggaaaccagagaaccataccatgaacattaatgcttccatttatgatgagattcagcaggaaatgaagcgtgctaaagtgtctcaagcactgtttgccaaggttgcagcaaccaaaagccaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcattgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcatatatcactgtaaggtacagttagggtaacactttagaggtttattatttttaaaaaacttttcttgaactcctggccaacatggtgaaaccccgtctctactaaaaataccaaaattagccaggcgtgatggtgggtgcctgtaatctcagctacttgggaggctgaagcaggagaactgcctgaacccaggaggcagaggttgcagtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttggtgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtggctgggactgcaggcgcccgccaccacacccggctaatttttttgtatttttagtagagacggggtttcaccctgttggccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6704 - DNA, 1210 bp, Homo sapiens
agacccacaccgcaggtctacgaccctcaggctcttcagctgcaatggcggtaatgatgcgcacgtcataagattcttcaaggtatttaatgaaataaaggatgtgtaaaggagaagggattttacatgagttagctatacctttctcttctttcttcttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaa

SEQ ID NO: 6705 - DNA, 422 bp, Homo sapiens
catgagccactgcgcccagacttcctaaactatttgaaatggagttgcacacccacagacaccttcggcaagtcccaagaaaaaggacttttctcttccagcaccacagtgctattgtcacactttaattatcttccagcctctaattattagagtttaatcttccctccatattcaaatgtcaaggtaaaagattagaaagatttttgtcatctaaggagcttggagtttatccattagggcttggggaggattgttttttatggaggcatctgagaggattagaaagaaacccagagtaaggccaggcacagtggctcacgcctgtaatcctagcactttgagaggccaaggtgggcggattgcttgcgtccaggagtgcaggaccagtctgggcaacacagcaaaactccatctctaca

SEQ ID NO: 6706 - DNA, 156 bp, Homo sapiens
agccccatggccttgagcaaacattggcagtagtcagggagtaattacagcagaccttgggcaagactcataaatgtgctggcttcaggtgtaacccaatgtagtcatagttctggatgccacagaggtgcttacgccactccaaacctagattta

SEQ ID NO: 6707 - DNA, 250 bp, Homo sapiens
tgggtggagagaaacataaatgtcgactacatgcaagtccagtcatataccttcccttgaacttaattatgatatagattattttgctcacatgttttttgttgacattctgcttattatcaccctgctctcctattacattcctttttgctgaaataatgaaaatcataatcaataaaaactgagggaactcagaggccagtgctcgtgcaggtcctggtgtgctgagtgccagtcccctggacccact

SEQ ID NO: 6708 - DNA, 260 bp, Homo sapiens
aaataggatgtgtaaagtgtaatattgcaccaagttgtttaccaaagtgttacttaacagagcaaaaatttggaaacaatctgtttaaacaataagaaaaatggtcaatgcgccagttgctctggctcaggcatttaatcctagcactttgggaagacaaggcgggtagactgctcgagcccagaagatggaggctgcagtgagctctgattgcttctttatactccagcctgggtgacagagtgagaccctgtctcttt

SEQ ID NO: 6709 - DNA, 425 bp, Homo sapiens
acattaatgacacctgggttagaatatctaggctctgctatttttgagctgagtggcttgaggcaagttgcttaacctttctgggccctggcttcctcatctgagcagtgatgaaccctagcctgtctacaaggtcaaatgaaacagtcaatgtgaaaattccgcccaggccacacagagctgcacagatgctggtgacctggcttactggcatgagatcacttccaagccctgaattacaggagagaaggagcctcttttctgaaggaccaggaaccagatttgttcaaacagccattctccaccccaagatggagcaactgcctcagcagccactataaaactaggaagctcctccagagacaccggtgcccttctctgtcctgcccaggataaaggcaagaaccctcctggcaatcgggaat

SEQ ID NO: 6710 - DNA, 450 bp, Homo sapiens
tctgtgtattttttagttcctcatccatgagcatacaggaccctgggctttattgattggctcacaatctggttctattggtttcaaactccaagtgacatttaaacaatggcaatatcgttgcaataagtagtttgcttttcatgattaccctcttccattacaagtaatgtatgtatgtgagttcaagcctactgagtgggcctttgtcctattcaaggagcatgattagacagcagtctatgccacccaacaccatcatgaaccagctacatgggcaatatttactctaggcatggcctcgaggacaggaggcacttcccactgtaaacatgtgaacgagcgagtagcctgcccatatctccatagccaaaccatcctcatatgagtccaataaaagacttcacttctctttccacattagatgctggaagaatagtaatgtcatgg

SEQ ID NO: 6711 - DNA, 670 bp, Homo sapiens
agcatctcccatgccaaagcattgtgttgcaatatcagtagcaacactcttagatatacaaccagtcactggacgaggcacttgtcatttaagcctcacagaagtcaggaattggatattaagcaaagatgtttgtttttcatagttcctaaaaagtgccaatcattatgaaagttcaatggatggcgcacggggacaggcatcagatgactgctcccagcactgcatcgtgaggttgtgtgccttcagaaaaccacatgttatctgcggctcagttttgtaatgccacatttaacaaggatgttgactggaaaacaatattcagaagagaccaaccagggaggataatgacgtcaaactatgtcacttaaaaaaaaaaaggtcactgggcgtggtggctcacgtctgtaatcccagcactttgggaggccaaggcaggtggatggcttgagctcaggaattcaataccagcctgggcaatatagcaaaaccccatctctacaaaaaattttaaaattagcaaggtgtagtggtgcaaacctgtgatcccagctacttgggaggctgaggtgggaggatcacttgagcctaggaggcaaaggctgcagtgaagaaccatgatcatgccactgcacttcagcctgggtgacagagcgagaccctgtgttta

SEQ ID NO: 6712 - DNA, 546 bp, Homo sapiens
aagggacaaggacgtgcacgccacagccacagccccagaccagggtgtaggccgtggggctccagctcccttctgggcatcactgctgtgtgtccttgggagagtgtctccgcctctctggcacctcccttcactctggaaacctgtccatcaggccaggggactggggtggcgtgcggcctacctcctcccaccttccgagcccaaccccaaaactggataagcagtcagcttgcactctgaacccagaactgaaacgaggattaagcttcgctttgtgcgtgccacaaaccagacaccacatccaacctccggctctagggccaggaactccaatcaccaagcatttttggaaaaccaaatcaaagctagatggcttttctaacatgttatattgtattaaagattgaaaatgacattgagaagtaaaaataaattggaaataactggaaaaatctaaatgtccagtaacattgggggattcattaaaaattctgacccaatggaacgtcgacgagccaccacaatgacctttttaaagaatgt

SEQ ID NO: 6713 - DNA, 522 bp, Homo sapiens
cagtagtgagtcctggcagggtggggcagacataggcagcaggtacatcacaaaggagttcggctttccttctaagtgctatgggatgccaatgggtgagtttaagtgggggagtggcacttcagtttaaagagaccactctggctggtctctccatggactgccaggggcaaacacagaggcagagatggattaggaggtgatatggaagtccagtgagagatgtcagaggttcggactgggatggtagcaggagaggagaggaaagtagatgaattcaggtaaatttggagatatgacaataggtcatagtgataggctggatgtgggatatgagggaaaaagagcaatcaagggtgatgcctaaggttcggggctctagcagccagatatataacagtgttatttactgagatgggggtaccaagaggtgaggaagaaaggaagaaagtaaggctgggattaagagttatgatttggatacattaaatttgagatgcctctcagattcaagtctggaag

SEQ ID NO: 6714 - DNA, 312 bp, Homo sapiens
gcttcacatttgcatgtttcagtgctagagcatgggaatagactttggcatccactgtaagatgtttttcagctacgagagcatcgagtccctgcagcaggtcattcttgggtaacgaaatgacttccacaaattctccatcccctggctttggcttgggccttacattttctgcgtcatctccgttaatgattactgtcacgatgtgtgtggtacagtttgacaaacctgggtccatatagaccactggagaacattcagcagcgtcccctttgtagccagtttcttcctcaagctcccaaagagcagctg

SEQ ID NO: 6715 - DNA, 1144 bp, Homo sapiens
tactgggattataggtgtgagccactgtacccggcctctctgcttatctttggtgtcttataatttctgctttttaaatattggctcgcccatccactttgttttttctccatctctctttttttttttttttgagacggagtctcgctctgttacccaggctagagtgcagtggtaagatctcagctcactgcaacctctgcctcctgggttcaagtgattctcctgcctcaacctcgaatacctgggattacaggcaccagccaccatgcctggctaatttttgtatttttagtagagatggggtttcaccaaattggccagcctggtctcgaactcctgacatcaggtcatcctcccgcctcggcctcccaaagtgctgagattacaagcatgagccattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgagaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatggggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccag

SEQ ID NO: 6716 - DNA, 1074 bp, Homo sapiens
aagtaaaaaaagaagctgtgtcttaaagatgcatcttcctttaaagtaatgaataacaaaggtaggccataaggagcttcttatctactttaagctctggctggcttttccaggaagtttgaggagataaatcatgactcattttctgcagggtcagtggggaaactggagaggtggctgtccctgttcctgccggtgcctgaagctttcagtgttgttccatcacactctggctccatacctttcctcctgtcctccctccctgttggctggagtctaatgtgacacttcttccaaaacacagaaccgcctacattgtgtaaactgattattgcgcccagccctccatctcatatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgagaagacaaatttactaggcctgttgtatcccagtttagttaagatatttatatacccacagcaacagtttgtggatcttcacttttgttttctgccattaatatgatgattaccctgttttgctgcttttactttgcttgtttcttatagcttagcttataaagtatccattaacaactgactgttggacttctctctctttgtttcaaggactgcaattgcaaatgcctgtaggatccagatgccataaatgtataagatggttctggtgttttcttcttttcttgaaacactgtcttgtgtgtgtgaggggggtgatcttttgttcagtcatttttgatagagacattagaagagcgatttctttaaaatataaacaagggtgcaaatggggatggtaaagggcaactgacgctactaggaggatagtagggagtgtttgacattgtgtgtaattgggacatacatatttcctccaaaagggaagactttagtacttctgctgattgttgcctagtggaaatgtctgcctaagattaccag

SEQ ID NO: 6717 - DNA, 464 bp, Homo sapiens
tactgggattataggtgtgagccactgtacccggcctctctgcttatctttggtgtcttataatttctgctttttaaatattggctcgcccatccactttgttttttctccatctctctttttttttttttttgagacggagtctcgctctgttacccaggctagagtgcagtggtaagatctcagctcactgcaacctctgcctcctgggttcaagtgattctcctgcctcaacctcgaatacctgggattacaggcaccagccaccatgcctggctaatttttgtatttttagtagagatggggtttcaccaaattggccagcctggtctcgaactcctgacatcaggtcatcctcccgcctcggcctcccaaagtgctgagattacaagcatgagcctggccaggaaagggggtttcctcttcctttaggcatggtacagttctgtctctaccttgccctc

SEQ ID NO: 6718 - DNA, 198 bp, Homo sapiens
tgatctcctaatatttcctcaaatattttaatatttaatattttaaaacatctacagattgcaaaagcaataataatattaaaatgttgtaccttacagagaagcagtcacagaattgtaaattctaaaaataaatcatagacaatgccacccccccagcaaccactcacgtaccctccagtgcaaacctttatttac

SEQ ID NO: 6719 - DNA, 540 bp, Homo sapiens
cctctctgagcatatatattttttaattttatgcagcttctatatattctacacctactgcccgccagcatatcgctggatgctggtggtatgatggcaagatgggaacaggtagggtctgtgcactcctgtagcttccaggctaatcttaggttgctcatctgtgaaatgggtgtgagaacctcatcctgcagttgttatgtgttgtgtgagaattaactgggataatgtgtttgaggtcctggcagcgattagaggctcataattggtcgatgtagctgtaggatttgctttttctgctgagcttagttgatgacaccttctaatttgctaccttaaatttacagcagctatttttttttttcatagatcttttctgcattcacattttaactcacagatattgttcaggtcctggaagtgtgagctttctctctttcttcttgaatgtcttgtatataggtccttaagcaactcattcatttcagagatattctttttattccaggcttttgagatacaacagtgaccaagacagac

SEQ ID NO: 6720 - DNA, 403 bp, Homo sapiens
gcgtcgacagaaattatagagaattccttacatttaatcctacaagtactggcttcatgaaaacctcttataaggagatcagcaggtaaggattcctgagtgctagatgttgtgttaatagaagtttataaagtttcacatagtttatagggagactgaaagcagggattaaggaccttctatctcctctactagactcaggtagtggatggaaaggaaatacaaacatttttaatttaacataattagggttttttttgtttgtttgtttctttttttgagacggagtctcactctgtcaccgaggctggaggttgcagtgagccgggatcgcacctttgcactccagcctgggcaataagagcgaaactccgtctcaaaaaaacaaacaaacaaacaaaca

SEQ ID NO: 6721 - DNA, 379 bp, Homo sapiens
tttttttaaagtagagtcgggatttcgccatgttggccaggctggtctcaaactcctgacctcaggtgatccaccggtctcagcctcccaaagtgctgggattacaggcgtgagccactgcgcccggcctgtgcctggcttattttgtttagcctaatgtccttcaggtttatgcatgttgtagcacgtgtcagaattttcttctcttttaaggctaaatgatactcagttgtatgtgcagattacattttgtttatcccttcatcagtggacacttgggttgcttccaccttttggctatggcaaatgatgctatgaacatagatacacaaatatcaaacagatgggtgtacggatattaaagagtccttgctttcag

SEQ ID NO: 6722 - DNA, 435 bp, Homo sapiens
acaaagtggctgtattcacacccacagaaacaaatagtttcttattaacttttaatgacttgctgtcttctaatgaattcacaaagaactgctgggaattacactcagatacactaaagaaaggtgatagattattaaatttgggattgcttcaaccttttacctttagtggtttcagacactacccaaatcaccagggaaagagaattaagagaactaaagctaaataagacactccagggaagaagcttaacttaatgagacaagttgtttcaaccttccccaatggtaagcaggaggctcctgagccttttacaatactacacaattgttgctgcagtgatattaactcctaaaatatctgaactcctgtttcctctactccaaaatgtaagtttctttttaattcagaaatttttaataaagtgttttaca

SEQ ID NO: 6723 - DNA, 449 bp, Homo sapiens
acccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctatt

SEQ ID NO: 6724 - DNA, 423 bp, Homo sapiens
ctgtgaaagaagggagccccctccatctcgcattttctcagggttcccaggggcctctgagcagcttctgaagctccacagctccgactgacaccccctggaaattgcttaatgctttcagcctgaggaaactcaaatcagccagtcagtcaatcctgaactactctggaagagcagagtagagtctcacagtctcaaaacctggatggtctaaaatatgagtaacttttatgttgagcatcccctgccccagaccttctgagacaagaatcggccgctgcagcttaattctcaaccttcctcctccagggccaggatgaaagagagcaggaggtggtgggggtggtaaaagaaaacctcctcctctgaactggcttagggcagccccgctgcaggcgacaactgttcttccaagacctactt

SEQ ID NO: 6725 - DNA, 373 bp, Homo sapiens
ctcaccccgcgagcactgtctgttcagcttgcagggggcaagacttaaacacagtaggtgccaacagtcagggatgaggcccagcaggagaaagacttaaacacagtaggtgccaacagtcagggatgagaagcatgacagccgggtgtgaacacaggcacagggagacaaggaagggaggggcaagggtctggccccaaaaatgcacgcagcagctccctgtttctcaagcacagagcgagtcctagagcctcaatctcccaaaatgcctctctcagctctggaaccagccctggggccgcaggagtggccttgtctccaccttcccacaggatattcccctgccgcgctctgagtgactgttatgagataa

SEQ ID NO: 6726 - DNA, 521 bp, Homo sapiens
tacctgataggtgtgacagaaattttaagttacttcaaatcagtcccactgatactgactaaatcaaaagcagagtcaaagccaggtgtggtggcgtgtgcttgtggtcccagctccttgggaggctgaggctggaggatcacttaaggccaggagtttgaggctgtagggtgctatgattgtgcctgtgcgtagccattgcaccccagcctgggcaacatatcttaataaaaaacaagagtcatactaggcacagtggctcacacttgtaatctcaacactttgggaggctgaggcaggaggatcactttagtccaggagttcaagaccagcctgggcaacatactgagactctcactgcaaaaaatataaattagctgggcatggtgacacacacctgtagtcccagctgcttgggaatctgaggtgggagaattgcttgagcccaggaggtcagtgcttcagtgagctgttactgtgctaccgcactccagcctgggcgatagaggaagactctctca

SEQ ID NO: 6727 - DNA, 603 bp, Homo sapiens
gatgatctcaggtggaacagtttcatcccaaaaccatccctccacctgaccctcacccgagtctgtggaaaaattgtcttccacaaaaccagtccctggtgccaaaaaggttggggaaggctgggctacaggaccagttgagtcatgagtcatgagtctgggtggggttggtctgaaaaaaatctctcagaaaaccagtcttaggttctataatagtgatgttatctataggagcagttggagaagtcacaaatcttgtgatctctagccacatgactcccaagcagtaagaaattgtagaactatacctacattttagcagaattctctcccctcccataatcctaaccttgtggcctttccttagttttacaaaggtagtttagttttgggaagggctattatcatccttgctttaaggttaaactgtaaactaaattcctcccaaagttagcttggcctatgcccaggaatgaccaaagacaaacagcttgaggttggaggcaagatagagttaacgatgtcagatttctcttttgcaaaggtggtttcagttgtgccactgaaacacagactgggtgatatagtgagaccatgtatgtt

SEQ ID NO: 6728 - DNA, 2702 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6729 - DNA, 2615 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6730 - DNA, 2787 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6731 - DNA, 2787 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6732 - DNA, 2923 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6733 - DNA, 2755 bp, Homo sapiens
acccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6734 - DNA, 2589 bp, Homo sapiens
  misc_feature (27)..(27): n is a, c, g, or t
tggctggtactggcccgaagttcgtantgattggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6735 - DNA, 2450 bp, Homo sapiens
  misc_feature (27)..(27): n is a, c, g, or t
tggctggtactggcccgaagttcgtantgattggcacccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6736 - DNA, 2502 bp, Homo sapiens
  misc_feature (27)..(27): n is a, c, g, or t
tggctggtactggcccgaagttcgtantgattggcacccagggtccggcctgcgccttcccgccaggcctggacactggttcaacacctgtgacttcatgtgtgcgcgccggccacagtccctggttcaacacctgtgacttcatgtgtgcgcgccggccacacctgcacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6737 - DNA, 2744 bp, Homo sapiens
gctggtacggccggatttgggattggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6738 - DNA, 2921 bp, Homo sapiens
acccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6739 - DNA, 2868 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6740 - DNA, 2434 bp, Homo sapiens
gctggtactggccggaagtctctttggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6741 - DNA, 2644 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagtgggcggacccccaggctccgccagcccctccaccccagcctgcctgctgcctcggaactgtgacacccccatcttcgacttcagagtcttcttccaagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6742 - DNA, 2870 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgctgcctcggaactgtgacacccccatcttcgacttcagagtcttcttccaaggtcagtgaggcccttgcctggggggctgtctccaggggtccttgggagcacctgcctgccaggtactcagcagagtccccttcagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6743 - DNA, 2664 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatggagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6744 - DNA, 2735 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggacccccaggctccgccagcccctccaccccagcctgcctgagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6745 - DNA, 2210 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacagggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6746 - DNA, 2191 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcaggtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6747 - DNA, 2094 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacagcgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6748 - DNA, 2097 bp, Homo sapiens
cataaaagcgccggccctccgcttccccgcgagacgaaacttcccgtcccggcggctctggcacccaggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6749 - DNA, 1338 bp, Homo sapiens
aattcggcacgaggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagccacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtgctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6750 - DNA, 1180 bp, Homo sapiens
aaggtggagaaaactcagtccatgcctaaattaggatgtcccacttcctccctgcctctttgcctagctgtgagcacccaggctgtgggatttacagccggcgtccgccgctgacgtacgatggggaccctggctgcccagttcccagtttctctggattcccagttcccagtttctctggattcctacctcttgctctctgaagctgttggcaaatagaaaatactgaaattcatttattcaatcaaggccccctggtgtggttttgtgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacaaaaaaaagaggacaacaactgacaacacaacacacaccacacgactcctcaccgagcgacaacagagcacatccgccgcgctctcatttatgggcggacggccgcgcaaaacggcgactgcaaagcggggcccgactgtgcaaacaatgttttgtccgcaccacccattctgttctgtacacgagagggtgcgaacatatctgccggggggcgctcccccacataagagggggcggtccggcaataatcaatctggaagaaacagccaccgaggatagaaaccacttttattatatagatcgggtagggcgacagcaatgagagacaagccgacgcagagcaaagcagccggaggtagcacactaccgcgtactatacactactaaagcagtaggatagacctgacgtatcacggcactacacctgcaaacacaacacatccacattcgctcacactcctctcatcatccatcctacccgacaccacacgaagacaacataagaacatctattgacccactcgcacatccatcacgctacttcacacaacaagaatcatttgcacatgatcgaataatataagttgatcatcccgactttcgatatcaagcagattgactcacaatccattcgataatatctacatagagacctgcgcaactcgtcaacccacagagaaagacaccagctactctctaagccagcacaacgcaccactgaagaaccgacagatccatcgacagtcatata

SEQ ID NO: 6751 - DNA, 494 bp, Homo sapiens
agctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactc

SEQ ID NO: 6752 - DNA, 572 bp, Homo sapiens
tttaagtgtgttgattctcacatgaaaatcgaagcttgtcgtggcctttaagggtcaggttccagcgtattatggaagccgccacatggtcgttttcttctttcctcctaattctctgattcagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaaggtagggcatgctcactgcgttacagagaattagcaagctctgcccatggagggcgtggtggggagcctgtcctggaaagagtccttgactttgactcaggagtagcccgtgcaggaattaggggataccaggggaaatttttagggtcattgcactttgaaataactagtgaattgggcccatggaaattattctaggaaactcttaaagagaagtggtatttc

SEQ ID NO: 6753 - DNA, 1890 bp, Homo sapiens
  misc_feature (19)..(19): n is a, c, g, or t
  misc_feature (23)..(23): n is a, c, g, or t
ggcaaggattacccccctngggngtatgggatatcgtcgaccagggcctcgatttgaggagattcagctcagcagcctttccctctggatgccaaagtgactatttagtggacggcccagacgttttctgtattcatgttttgtatgttgcttctagaatggcttattgatgtgtggtggaatattggtgtttgtgcacatatgtgtgtgtgcttataacccttgaaatagggcagtttaatcttacttatcccaagcaaacagaggagtaaaggtacagaaaatgccggcaaagaggtaggaaacacagaggctgagaagcagcaatgtatatcgaataaatgacatcagtgagaaagtagagagaatcaggcaaaggtaatagtcaaagaaataactaagaattctctacaattaaagaaaaacataaattctcagattttagacatagagattcaaagcaagatgaattacacgttgatccatacctaggccgatgcaatggaggccgcggagcaccaggcccagggtgaatctcccgagagcaactggagagaaaacatggctgcctacacaggaaccgctattccactgacccacaggctgggggcgggttctcaaagcgaagaaggacgtggctcttttaacctgagcggccacgtccagcaaagtacagtcctttagaaagggcgatgggccgcaggaggcagagcgggggagcttgctgcccatagaatctaaggaaatagttaatgatgcactcgctgcagggaagagcacactgaaccacggaggaggtgacgggggcccggagggagtggggagcccgggaagtgtcgggcgtgtggagagtcgataccagcaccgctcaagacagcgctgatagtgccgattgagtttcagatgcagccggagccccagccagtgccgactgaagaggagggtgaccgttcatgccgtgtgttctgaagttctgaagtcggcatttttcagggggaggatcttgttaccgatttttttttttttttttgctatggattggtccagtttgcgttttatgggtaactgctaagaaaataggaatagattattttaactttgaaaccagtagtgcaaaacccaatctggtaaatgcaagaaaatataaaataagaaagctttgcaaatcatatgagaaaagactgcaaaataagtacaaacatattggtacgcatagtaaagtgcatcctattgccagtaaaagaaatcctcagattggataaaatagcaaagctagccataaattcttgtgagagatacataagagtacagaagatttgtaagtaaatggatggaaaaagaaatataatgcaaattctaaccaaagtattgtcagtataactataataatacactaaatgttaagccataagcaaggaataattcatgaggaagatatataacagttctaaactcatatgcacctaacagcatagccttaagatatataagcaaaatataacaaggcttaatcagagatatgtaaatacgctgttggggtgagagattttaagaaaactgtctctgctattgacagatcctggacataaaatcagtaaaccggccaggcacggtcgctcacgcctgtcatcccaacactttgggaggccaaggtggatggatcacttgaggtcgggagttcaagaccagcctggccaacatggtgaaaccccatctctactaaaaatacaaaaattagacaggcgtggtggcgggcgcctgtaatcccagctacttgggaggctgaggcaggagaatcacttgaacccaggaagcggaggctgcagtgagtcgagattgtgccactgctctccagcctgggaaatgagtgaaaactctgtgtcaaaaaaa

SEQ ID NO: 6754 - DNA, 5399 bp, Homo sapiens
tccttcttgcaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6755 - DNA, 3718 bp, Homo sapiens
catttgccaggctacatttcagcttgatgcttacataactacttgtctgcagcagtactctgaatttatgtgggctttcccgtattcactgaaggccctggctcacagggagatgcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6756 - DNA, 2261 bp, Homo sapiens
gctggattatctgcctaggaaccaagtcacaagtcagtgatgcagactcctttgcaattggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6757 - DNA, 6407 bp, Homo sapiens
ttccccaaattgatggacataaacccatatgcttatctcagcatgtgtttaaaaagcacttgctgagattcagtgaccatccaacattaaaaactgctgatagaaggaaactcacttagctgaattaaggacgtgttcttaaaatctaccgccaacgtaatggggaggagctcacggcgttcgttaatttattcattccgcaaatatgttttgggcagttacataccgaatagtagatggaggtgtgcctgctgtcatggagatagggtgatttcatcctgttgatcaggaaaactcctaggtgcttgcaggtaaatgtgccacaaagaaagtgaggaccaaaggttagttgatgtaaaaacaagtttgaaatgcattttggggtaatttatccggtcgcttcgggcattcctcgcggaaggcgtggtctggtgactcagaagccaacacactgcgggagtccagccgtcggccccctgccgtgtggcgaggcccagtgtgtcccctttgtaaggacagcacaagcaggagttaatggaccggccatccatagcggtggtggggcagggagccagtttccgaaagaaactcacgccgccgcaggagggccctgtgggatgctctgtgcagagctgttgtgcggaccgggagacgggaaagcctggtggctgcaggagggcaccgtgcagaagtatccagtaaaccacccacagcacggcagcagaaaaacgaggaaattatatgtgtgtatgtttataagaactcagaagcaatggtgagcaaaaagcaaaagcaagaggagaaagtcacagtgtgctggcatcaagttgcattgagaggagcccgcggggtagtgcacccgcatttcctcgttgcgttgagaggcgcccgcggggtagtgcacccgcatttcctcgtttgagaggcgcccgcggggtagtgcacccgcatttcctagttgccttgagaggtgccgcggggtagtgcacccgcatttcctagttgccttgagaggtgcccgcggggtagtgcacccgcatttcctagttgccttgagaggtgccgcggggtagtgcacccgcatttcctcgtttcattgagcggtgcccgcggggtagtgcactcgcatttcctagttgccttgagaggtgccgcggggtagtgcacccacatttcttcactcgtttagagttcggggctctcagaacacagggagaatatgggagaattccttactagatgttacagaggccacacagggccacttttttcttttttttttattgtgtcaggtatacgtaaatattcctttcggtcagttcagcacgtaggactgagtggcattaggtacgctcactgtacagccaatgcctccataggccactttttaaatacgcggggctaagggccaacgacaagattgtcatcgaggacaataagtcgatggcgctgcctggtcactggcttggtcagaaaacacatgccagggtgactggatttaacgttcagttttagaaccacaaatctgccagcccaggcattcaagaggaagtgagtaattcactgaattgatggttagcaagacccttcaaagtccttggaagttccgtgtttgctgggggtcacaacagcaattgcgtttctaaaacattgaaaaccacccgtttttcacacatctgaatagcctgagttgtaacagacctaagtaaaggcgtccaaacgtgcctgatcctgtggctgggtcccaggagccttaacaaggcattgagagagctggattgattgattagactcttgccaactgctgtgcggaatacagaaaatgcagctccagctctcaaagggctgaaaatctaattgaggtgaaaaaggtaacatgtgtgaaaaccatgtctgtgtagacttgttttgtatggaccagaaaagttggaagtccagagatggatgcgaggaagtaggggatggagtttccttataacctctggagggacagtccagatacataccggggtgtgtagcgggtggaggttctaagacaggctggaggaacagtgcagacacacaccagggtgtgtagggggtagaggttctaagacagtctggagggagagtgcagacacacaccggggtgtgtaagcagtggaggttctaagacaggctggaggaacagtggagacacacaccagggcgtgtagggggtagaggttctaagacaggctggaggaacagtggagacacacaccacggcgtgtagggggtagaggttctaagacagtctggtgggagagtgcagacacacccggggccgtgtagggggtacaggttctaagacagtctggtgggagagtgcagacacacacggggctgtgtcggggatagaggttctaagacagtctggtgggagagtgcagacacacaccagggcgtgtagggggtggaggttctaagacaggctggaggaacagtggagacacacactggggagcataggggtgcttttctctgagtcccctagtacatggtagaggctgtagaccctccgctcttgggcacgtgggtaggctctcaggatgactcttggctcttgggcatgtgggtgagctctcaggatgatgcccagccccaattttcaggcaattgtgcaaggacttgacccattcatccgctgagctgagttgctgagactgctgggtgcccgggtggtgatcattgtccgtggcatacagaacacactgcagcttctgcaaagtgagctcatttcacgcattttatggctttgccaggctgctgttgacctgccagaacttttaatcagacatttggaggacctgttttgtagtcagtggagaaatattacaaggatagggtaatttgaaatatctaaggattgtaagtgacaagttcatgtctaattttgcatttccagtgaaagcaagtgttggctttgaatgttacttatgtgctgagatgtgtatattcctcagtgcttaattactaaggatttttagggccaagttttgttacagtgaatgattgtggatgcataaagaataaatttaatatttttaaggcatggagattatttgtatctaagaaaccaggtaaaataaagaaacatttatgcttgtgtgactgataaaagagttagagagacactcatattctgggagtttgaagaatgtcattttcattctctaaaagtcttgttagtgtcacagcattgaaaatttaaaaatccgtgtgtattttcttgctagtgctggtacttgaatatctgtatcatccacctatccatccacctacccatatttctataatccaccgtccctcgacatgcctatcatctgtccaccatttctctctgtctaattttcaaaacatcctgtaagtttatataaaggaagatttttcttcttgtgaagttctctaaggctgacaagttacctggcatgactgtggcggatgcccatagccaggtggtcctcggggtacagatggggcaggggcacttgtgagaaacacctgaagtgcttttccccagcctccccggccctgccgggtggtggaggcgctgcacggtgccttccatggagcaagcccggggctccgcagggtcctcagcatgattcagatttccttccacccccagctctagatgatttggtaaaaccacaaacaggcacaaaacagcccacatggaattctaaagttttaatttcattttggaatttatgcactcagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtgggtaagatgtgtttatttggttttggtacaagttcacagagaatcaacgttcatggtcggtgtgatgagagactgagatgtgaattgctcagtagagagttggcggtggcgtatcccagagtgtacttagaaacatgaaaacttctttgaaagggagctgatcacttttggaaaagatttacagttcttaggaatgcaaatatttgtttcttttccttttcatctaaaacatttaccagataaagttgagtccagagacaactaactaataagagaataattttaatatgtttttccattttggtgtcaacattgcatggattttttttcttgttccaagactggctttttccagtggaaacttagcagttaaaattaatttgttccaaatgaaatattgcatctgaaattaggctggaattgcagtagacgttcctggttcttgcaaaccagaggacattcttgaagctgtgtggtcccaggctctcccctctctggtttcctgtgttccctccctgcagcctcagactcgccctccagggctccactgtgcttttccaaactctcatcctttcctcccaggcgtcctgtgcagcacgccactgcctctcacttctcacatccacagctcctgcttggtcagtgttcc

SEQ ID NO: 6758 - DNA, 369 bp, Homo sapiens
cattggaagtaagtcatccatttaagacgttatgtagtctaggagcctcttagctctgttttatatgtgagcgtttgattttattccattttagattgaatgtgctgcttataaccctgaaccttacctaaataatgaaagccagccagattcattttccacggcacatggtttcctgtgggtaagatgtgtttatttggttttggtacaagttcacagagaatcaacgttcatggtcggtgtgatgagagactgagatgtgaattgctcagtagagagttggcggtggcgtatcccagagtgtacttagaaacatgaaaacttctttgaaagggagctgatcacttttggaaaagatttacagttctt

SEQ ID NO: 6759 - DNA, 385 bp, Homo sapiens
cgtttggagtaattcccttcgcccagagttcttaaccggggtggatggaggccttcgggagagtcacaccaatgtggaaattgtatgtaaaaccttaacagcctgtcttaacagcattttcttaggaaagagattcatacattcattagaccctcaaatggatccaggacctcccaaggggttaagagcaactcctttagcttacttttcctttcaaaataacggtatttaatttcagatagtaatagttaaagctgaaaatatttacaggctaggcacagtggctcacacctgtaagcccagcactttgggaggctgaggtgggaagatcgctggaacccaggagttcaagaccagcctgggcatgatagtgagaacccatatc

SEQ ID NO: 6760 - DNA, 306 bp, Homo sapiens
tgttcagccaagtcgtgactcactcagctcatcatcccttcccaagaactgactttatttttccccaggatggcagatgccactgcctcctttccattgtcagctggcgggtgacgcgactgttgttgcactgggagtgtccacgtggtaactgcccacctctcccctgttgcttgtaggacatgctgaagaacacctccaaaggccaccccgacaggctgcctcttcagatggccctgacagagctcgaaacactagcagagaagttaaatgaaagaaagagagatgctgatcaacgctgtgaag

SEQ ID NO: 6761 - DNA, 565 bp, Homo sapiens
cgttgtgagcagggcctaagaggtcctcaaaggggtggctgaaaaaccagaagacagttcaggccttctagggcaaggaccgtattgcggctgtattgcccttgcccgtgttctgtgccgtgcgtaggccaaacatctggaatacttatttacagagttatgagtgaaagcttgaacttgggatgtcctataataatagctgggaaaatatgtgatttcctgtatagtaacatatatatatatattttgacacacacacacacacacacacacactctgcagggcagttggcatcctagtgacttgggctgtgcctggatattctgactttatggtttgttttctttaagtgaagatcaagtcggtcgagaggacagcgcacttgcccgctgggccgcagacccggccaacacagcctggatggagagtaagttccccagctgcccacagccagaatcctcaccacgctccacagacgtcactgcggcggggccgggtccctgagtctcaggtcccatcagatctaaaactctaaaaagatgtttatttactgaaaatagtaaca

SEQ ID NO: 6762 - DNA, 8486 bp, Homo sapiens
ttccccaaattgatggacataaacccatatgcttatctcagcatgtgtttaaaaagcacttgctgagattcagtgaccatccaacattaaaaactgctgatagaaggaaactcacttagctgaattaaggacgtgttcttaaaatctaccgccaacgtaatggggaggagctcacggcgttcgttaatttattcattccgcaaatatgttttgggcagttacataccgaatagtagatggaggtgtgcctgctgtcatggagatagggtgatttcatcctgttgatcaggaaaactcctaggtgcttgcaggtaaatgtgccacaaagaaagtgaggaccaaaggttagttgatgtaaaaacaagtttgaaatgcattttggggtaatttatccggtcgcttcgggcattcctcgcggaaggcgtggtctggtgactcagaagccaacacactgcgggagtccagccgtcggccccctgccgtgtggcgaggcccagtgtgtcccctttgtaaggacagcacaagcaggagttaatggaccggccatccatagcggtggtggggcagggagccagtttccgaaagaaactcacgccgccgcaggagggccctgtgggatgctctgtgcagagctgttgtgcggaccgggagacgggaaagcctggtggctgcaggagggcaccgtgcagaagtatccagtaaaccacccacagcacggcagcagaaaaacgaggaaattatatgtgtgtatgtttataagaactcagaagcaatggtgagcaaaaagcaaaagcaagaggagaaagtcacagtgtgctggcatcaagttgcattgagaggagcccgcggggtagtgcacccgcatttcctcgttgcgttgagaggcgcccgcggggtagtgcacccgcatttcctcgtttgagaggcgcccgcggggtagtgcacccgcatttcctagttgccttgagaggtgccgcggggtagtgcacccgcatttcctagttgccttgagaggtgcccgcggggtagtgcacccgcatttcctagttgccttgagaggtgccgcggggtagtgcacccgcatttcctcgtttcattgagcggtgcccgcggggtagtgcactcgcatttcctagttgccttgagaggtgccgcggggtagtgcacccacatttcttcactcgtttagagttcggggctctcagaacacagggagaatatgggagaattccttactagatgttacagaggccacacagggccacttttttcttttttttttattgtgtcaggtatacgtaaatattcctttcggtcagttcagcacgtaggactgagtggcattaggtacgctcactgtacagccaatgcctccataggccactttttaaatacgcggggctaagggccaacgacaagattgtcatcgaggacaataagtcgatggcgctgcctggtcactggcttggtcagaaaacacatgccagggtgactggatttaacgttcagttttagaaccacaaatctgccagcccaggcattcaagaggaagtgagtaattcactgaattgatggttagcaagacccttcaaagtccttggaagttccgtgtttgctgggggtcacaacagcaattgcgtttctaaaacattgaaaaccacccgtttttcacacatctgaatagcctgagttgtaacagacctaagtaaaggcgtccaaacgtgcctgatcctgtggctgggtcccaggagccttaacaaggcattgagagagctggattgattgattagactcttgccaactgctgtgcggaatacagaaaatgcagctccagctctcaaagggctgaaaatctaattgaggtgaaaaaggtaacatgtgtgaaaaccatgtctgtgtagacttgttttgtatggaccagaaaagttggaagtccagagatggatgcgaggaagtaggggatggagtttccttataacctctggagggacagtccagatacataccggggtgtgtagcgggtggaggttctaagacaggctggaggaacagtgcagacacacaccagggtgtgtagggggtagaggttctaagacagtctggagggagagtgcagacacacaccggggtgtgtaagcagtggaggttctaagacaggctggaggaacagtggagacacacaccagggcgtgtagggggtagaggttctaagacaggctggaggaacagtggagacacacaccacggcgtgtagggggtagaggttctaagacagtctggtgggagagtgcagacacacccggggccgtgtagggggtacaggttctaagacagtctggtgggagagtgcagacacacacggggctgtgtcggggatagaggttctaagacagtctggtgggagagtgcagacacacaccagggcgtgtagggggtggaggttctaagacaggctggaggaacagtggagacacacactggggagcataggggtgcttttctctgagtcccctagtacatggtagaggctgtagaccctccgctcttgggcacgtgggtaggctctcaggatgactcttggctcttgggcatgtgggtgagctctcaggatgatgcccagccccaattttcaggcaattgtgcaaggacttgacccattcatccgctgagctgagttgctgagactgctgggtgcccgggtggtgatcattgtccgtggcatacagaacacactgcagcttctgcaaagtgagctcatttcacgcattttatggctttgccaggctgctgttgacctgccagaacttttaatcagacatttggaggacctgttttgtagtcagtggagaaatattacaaggatagggtaatttgaaatatctaaggattgtaagtgacaagttcatgtctaattttgcatttccagtgaaagcaagtgttggctttgaatgttacttatgtgctgagatgtgtatattcctcagtgcttaattactaaggatttttagggccaagttttgttacagtgaatgattgtggatgcataaagaataaatttaatatttttaaggcatggagattatttgtatctaagaaaccaggtaaaataaagaaacatttatgcttgtgtgactgataaaagagttagagagacactcatattctgggagtttgaagaatgtcattttcattctctaaaagtcttgttagtgtcacagcattgaaaatttaaaaatccgtgtgtattttcttgctagtgctggtacttgaatatctgtatcatccacctatccatccacctacccatatttctataatccaccgtccctcgacatgcctatcatctgtccaccatttctctctgtctaattttcaaaacatcctgtaagtttatataaaggaagatttttcttcttgtgaagttctctaaggctgacaagttacctggcatgactgtggcggatgcccatagccaggtggtcctcggggtacagatggggcaggggcacttgtgagaaacacctgaagtgcttttccccagcctccccggccctgccgggtggtggaggcgctgcacggtgccttccatggagcaagcccggggctccgcagggtcctcagcatgattcagatttccttccacccccagctctagatgatttggtaaaaccacaaacaggcacaaaacagcccacatggaattctaaagttttaatttcattttggaatttatgcactcagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6763 - DNA, 8399 bp, Homo sapiens
ttccccaaattgatggacataaacccatatgcttatctcagcatgtgtttaaaaagcacttgctgagattcagtgaccatccaacattaaaaactgctgatagaaggaaactcacttagctgaattaaggacgtgttcttaaaatctaccgccaacgtaatggggaggagctcacggcgttcgttaatttattcattccgcaaatatgttttgggcagttacataccgaatagtagatggaggtgtgcctgctgtcatggagatagggtgatttcatcctgttgatcaggaaaactcctaggtgcttgcaggtaaatgtgccacaaagaaagtgaggaccaaaggttagttgatgtaaaaacaagtttgaaatgcattttggggtaatttatccggtcgcttcgggcattcctcgcggaaggcgtggtctggtgactcagaagccaacacactgcgggagtccagccgtcggccccctgccgtgtggcgaggcccagtgtgtcccctttgtaaggacagcacaagcaggagttaatggaccggccatccatagcggtggtggggcagggagccagtttccgaaagaaactcacgccgccgcaggagggccctgtgggatgctctgtgcagagctgttgtgcggaccgggagacgggaaagcctggtggctgcaggagggcaccgtgcagaagtatccagtaaaccacccacagcacggcagcagaaaaacgaggaaattatatgtgtgtatgtttataagaactcagaagcaatggtgagcaaaaagcaaaagcaagaggagaaagtcacagtgtgctggcatcaagttgcattgagaggagcccgcggggtagtgcacccgcatttcctcgttgcgttgagaggcgcccgcggggtagtgcacccgcatttcctcgtttgagaggcgcccgcggggtagtgcacccgcatttcctagttgccttgagaggtgccgcggggtagtgcacccgcatttcctagttgccttgagaggtgcccgcggggtagtgcacccgcatttcctagttgccttgagaggtgccgcggggtagtgcacccgcatttcctcgtttcattgagcggtgcccgcggggtagtgcactcgcatttcctagttgccttgagaggtgccgcggggtagtgcacccacatttcttcactcgtttagagttcggggctctcagaacacagggagaatatgggagaattccttactagatgttacagaggccacacagggccacttttttcttttttttttattgtgtcaggtatacgtaaatattcctttcggtcagttcagcacgtaggactgagtggcattaggtacgctcactgtacagccaatgcctccataggccactttttaaatacgcggggctaagggccaacgacaagattgtcatcgaggacaataagtcgatggcgctgcctggtcactggcttggtcagaaaacacatgccagggtgactggatttaacgttcagttttagaaccacaaatctgccagcccaggcattcaagaggaagtgagtaattcactgaattgatggttagcaagacccttcaaagtccttggaagttccgtgtttgctgggggtcacaacagcaattgcgtttctaaaacattgaaaaccacccgtttttcacacatctgaatagcctgagttgtaacagacctaagtaaaggcgtccaaacgtgcctgatcctgtggctgggtcccaggagccttaacaaggcattgagagagctggattgattgattagactcttgccaactgctgtgcggaatacagaaaatgcagctccagctctcaaagggctgaaaatctaattgaggtgaaaaaggtaacatgtgtgaaaaccatgtctgtgtagacttgttttgtatggaccagaaaagttggaagtccagagatggatgcgaggaagtaggggatggagtttccttataacctctggagggacagtccagatacataccggggtgtgtagcgggtggaggttctaagacaggctggaggaacagtgcagacacacaccagggtgtgtagggggtagaggttctaagacagtctggagggagagtgcagacacacaccggggtgtgtaagcagtggaggttctaagacaggctggaggaacagtggagacacacaccagggcgtgtagggggtagaggttctaagacaggctggaggaacagtggagacacacaccacggcgtgtagggggtagaggttctaagacagtctggtgggagagtgcagacacacccggggccgtgtagggggtacaggttctaagacagtctggtgggagagtgcagacacacacggggctgtgtcggggatagaggttctaagacagtctggtgggagagtgcagacacacaccagggcgtgtagggggtggaggttctaagacaggctggaggaacagtggagacacacactggggagcataggggtgcttttctctgagtcccctagtacatggtagaggctgtagaccctccgctcttgggcacgtgggtaggctctcaggatgactcttggctcttgggcatgtgggtgagctctcaggatgatgcccagccccaattttcaggcaattgtgcaaggacttgacccattcatccgctgagctgagttgctgagactgctgggtgcccgggtggtgatcattgtccgtggcatacagaacacactgcagcttctgcaaagtgagctcatttcacgcattttatggctttgccaggctgctgttgacctgccagaacttttaatcagacatttggaggacctgttttgtagtcagtggagaaatattacaaggatagggtaatttgaaatatctaaggattgtaagtgacaagttcatgtctaattttgcatttccagtgaaagcaagtgttggctttgaatgttacttatgtgctgagatgtgtatattcctcagtgcttaattactaaggatttttagggccaagttttgttacagtgaatgattgtggatgcataaagaataaatttaatatttttaaggcatggagattatttgtatctaagaaaccaggtaaaataaagaaacatttatgcttgtgtgactgataaaagagttagagagacactcatattctgggagtttgaagaatgtcattttcattctctaaaagtcttgttagtgtcacagcattgaaaatttaaaaatccgtgtgtattttcttgctagtgctggtacttgaatatctgtatcatccacctatccatccacctacccatatttctataatccaccgtccctcgacatgcctatcatctgtccaccatttctctctgtctaattttcaaaacatcctgtaagtttatataaaggaagatttttcttcttgtgaagttctctaaggctgacaagttacctggcatgactgtggcggatgcccatagccaggtggtcctcggggtacagatggggcaggggcacttgtgagaaacacctgaagtgcttttccccagcctccccggccctgccgggtggtggaggcgctgcacggtgccttccatggagcaagcccggggctccgcagggtcctcagcatgattcagatttccttccacccccagctctagatgatttggtaaaaccacaaacaggcacaaaacagcccacatggaattctaaagttttaatttcattttggaatttatgcactcagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6764 - DNA, 5210 bp, Homo sapiens
caggtgtagtaccagcctctcagtttggcagcgttcctcttggctcgcacggtgtttcttcaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6765 - DNA, 8363 bp, Homo sapiens
ttccccaaattgatggacataaacccatatgcttatctcagcatgtgtttaaaaagcacttgctgagattcagtgaccatccaacattaaaaactgctgatagaaggaaactcacttagctgaattaaggacgtgttcttaaaatctaccgccaacgtaatggggaggagctcacggcgttcgttaatttattcattccgcaaatatgttttgggcagttacataccgaatagtagatggaggtgtgcctgctgtcatggagatagggtgatttcatcctgttgatcaggaaaactcctaggtgcttgcaggtaaatgtgccacaaagaaagtgaggaccaaaggttagttgatgtaaaaacaagtttgaaatgcattttggggtaatttatccggtcgcttcgggcattcctcgcggaaggcgtggtctggtgactcagaagccaacacactgcgggagtccagccgtcggccccctgccgtgtggcgaggcccagtgtgtcccctttgtaaggacagcacaagcaggagttaatggaccggccatccatagcggtggtggggcagggagccagtttccgaaagaaactcacgccgccgcaggagggccctgtgggatgctctgtgcagagctgttgtgcggaccgggagacgggaaagcctggtggctgcaggagggcaccgtgcagaagtatccagtaaaccacccacagcacggcagcagaaaaacgaggaaattatatgtgtgtatgtttataagaactcagaagcaatggtgagcaaaaagcaaaagcaagaggagaaagtcacagtgtgctggcatcaagttgcattgagaggagcccgcggggtagtgcacccgcatttcctcgttgcgttgagaggcgcccgcggggtagtgcacccgcatttcctcgtttgagaggcgcccgcggggtagtgcacccgcatttcctagttgccttgagaggtgccgcggggtagtgcacccgcatttcctagttgccttgagaggtgcccgcggggtagtgcacccgcatttcctagttgccttgagaggtgccgcggggtagtgcacccgcatttcctcgtttcattgagcggtgcccgcggggtagtgcactcgcatttcctagttgccttgagaggtgccgcggggtagtgcacccacatttcttcactcgtttagagttcggggctctcagaacacagggagaatatgggagaattccttactagatgttacagaggccacacagggccacttttttcttttttttttattgtgtcaggtatacgtaaatattcctttcggtcagttcagcacgtaggactgagtggcattaggtacgctcactgtacagccaatgcctccataggccactttttaaatacgcggggctaagggccaacgacaagattgtcatcgaggacaataagtcgatggcgctgcctggtcactggcttggtcagaaaacacatgccagggtgactggatttaacgttcagttttagaaccacaaatctgccagcccaggcattcaagaggaagtgagtaattcactgaattgatggttagcaagacccttcaaagtccttggaagttccgtgtttgctgggggtcacaacagcaattgcgtttctaaaacattgaaaaccacccgtttttcacacatctgaatagcctgagttgtaacagacctaagtaaaggcgtccaaacgtgcctgatcctgtggctgggtcccaggagccttaacaaggcattgagagagctggattgattgattagactcttgccaactgctgtgcggaatacagaaaatgcagctccagctctcaaagggctgaaaatctaattgaggtgaaaaaggtaacatgtgtgaaaaccatgtctgtgtagacttgttttgtatggaccagaaaagttggaagtccagagatggatgcgaggaagtaggggatggagtttccttataacctctggagggacagtccagatacataccggggtgtgtagcgggtggaggttctaagacaggctggaggaacagtgcagacacacaccagggtgtgtagggggtagaggttctaagacagtctggagggagagtgcagacacacaccggggtgtgtaagcagtggaggttctaagacaggctggaggaacagtggagacacacaccagggcgtgtagggggtagaggttctaagacaggctggaggaacagtggagacacacaccacggcgtgtagggggtagaggttctaagacagtctggtgggagagtgcagacacacccggggccgtgtagggggtacaggttctaagacagtctggtgggagagtgcagacacacacggggctgtgtcggggatagaggttctaagacagtctggtgggagagtgcagacacacaccagggcgtgtagggggtggaggttctaagacaggctggaggaacagtggagacacacactggggagcataggggtgcttttctctgagtcccctagtacatggtagaggctgtagaccctccgctcttgggcacgtgggtaggctctcaggatgactcttggctcttgggcatgtgggtgagctctcaggatgatgcccagccccaattttcaggcaattgtgcaaggacttgacccattcatccgctgagctgagttgctgagactgctgggtgcccgggtggtgatcattgtccgtggcatacagaacacactgcagcttctgcaaagtgagctcatttcacgcattttatggctttgccaggctgctgttgacctgccagaacttttaatcagacatttggaggacctgttttgtagtcagtggagaaatattacaaggatagggtaatttgaaatatctaaggattgtaagtgacaagttcatgtctaattttgcatttccagtgaaagcaagtgttggctttgaatgttacttatgtgctgagatgtgtatattcctcagtgcttaattactaaggatttttagggccaagttttgttacagtgaatgattgtggatgcataaagaataaatttaatatttttaaggcatggagattatttgtatctaagaaaccaggtaaaataaagaaacatttatgcttgtgtgactgataaaagagttagagagacactcatattctgggagtttgaagaatgtcattttcattctctaaaagtcttgttagtgtcacagcattgaaaatttaaaaatccgtgtgtattttcttgctagtgctggtacttgaatatctgtatcatccacctatccatccacctacccatatttctataatccaccgtccctcgacatgcctatcatctgtccaccatttctctctgtctaattttcaaaacatcctgtaagtttatataaaggaagatttttcttcttgtgaagttctctaaggctgacaagttacctggcatgactgtggcggatgcccatagccaggtggtcctcggggtacagatggggcaggggcacttgtgagaaacacctgaagtgcttttccccagcctccccggccctgccgggtggtggaggcgctgcacggtgccttccatggagcaagcccggggctccgcagggtcctcagcatgattcagatttccttccacccccagctctagatgatttggtaaaaccacaaacaggcacaaaacagcccacatggaattctaaagttttaatttcattttggaatttatgcactcagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccaggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6766 - DNA, 2851 bp, Homo sapiens
tttaagtgtgttgattctcacatgaaaatcgaagcttgtcgtggcctttaagggtcaggttccagcgtattatggaagccgccacatggtcgttttcttctttcctcctaattctctgattcagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatatgaatactaaatgttaaacttcatcagcgtcagacctattgtatcatattagagaatttgcagactaagaatttatgagaaaatatatgtattcggtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcagtcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgcaaaaaaaaaaat

SEQ ID NO: 6767 - DNA, 2601 bp, Homo sapiens
tccttcttgcaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccaggtttgattttgtctggaattgatttgaggagattcagctcagcagcctttccctctggatgccaaagtgactatttagtggacggcccagacgttttctgtattcatgttttgtatgttgcttctagaatggcttattgatgtgtggtggaatattggtgtttgtgcacatatgtgtgtgtgcttataacccttgaaatagggcagtttaatcttacttatcccaagcaaacagaggagtaaaggtacagaaaatgccggcaaagaggtaggaaacacagaggctgagaagcagcaatgtatatcgaataaatgacatcagtgagaaagtagagagaatcaggcaaaggtaatagtcaaagaaataactaagaattctctacaattaaagaaaaacataaattctcagattttagacatagagattcaaagcaagatgaattacacgttgatccatacctaggccgatgcaatggaggccgcggagcaccaggcccagggtgaatctcccgagagcaactggagagaaaacatggctgcctacacaggaaccgctattccactgacccacaggctgggggcgggttctcaaagcgaagaaggacgtggctcttttaacctgagcggccacgtccagcaaagtacagtcctttagaaagggcgatgggccgcaggaggcagagcgggggagcttgctgcccatagaatctaaggaaatagttaatgatgcactcgctgcagggaagagcacactgaaccacggaggaggtgacgggggcccggagggagtggggagcccgggaagtgtcgggcgtgtggagagtcgataccagcaccgctcaagacagcgctgatagtgccgattgagtttcagatgcagccggagccccagccagtgccgactgaagaggagggtgaccgttcatgccgtgtgttctgaagttctgaagtcggcatttttcagggggaggatcttgttaccgatttttttttttttttttgctatggattggtccagtttgcgttttatgggtaactgctaagaaaataggaatagattattttaactttgaaaccagtagtgcaaaacccaatctggtaaatgcaagaaaatataaaataagaaagctttgcaaatcatatgagaaaagactgcaaaataagtacaaacatattggtacgcatagtaaagtgcatcctattgccagtaaaagaaatcctcagattggataaaatagcaaagctagccataaattcttgtgagagatacataagagtacagaagatttgtaagtaaatggatggaaaaagaaatataatgcaaattctaaccaaagtattgtcagtataactataataatacactaaatgttaagccataagcaaggaataattcatgaggaagatatataacagttctaaactcatatgcacctaacagcatagccttaagatatataagcaaaatataacaaggcttaatcagagatatgtaaatacgctgttggggtgagagattttaagaaaactgtctctgctattgacagatcctggacataaaatcagtaaaccggccaggcacggtcgctcacgcctgtcatcccaacactttgggaggccaaggtggatggatcacttgaggtcgggagttcaagaccagcctggccaacatggtgaaaccccatctctactaaaaatacaaaaattagacaggcgtggtggcgggcgcctgtaatcccagctacttgggaggctgaggcaggagaatcacttgaacccaggaagcggaggctgcagtgagtcgagattgtgccactgctctccagcctgggaaatgagtgaaaactctgtgtcaaaaaaa

SEQ ID NO: 6768 - DNA, 5528 bp, Homo sapiens
ttccccaaattgatggacataaacccatatgcttatctcagcatgtgtttaaaaagcacttgctgagattcagtgaccatccaacattaaaaactgctgatagaaggaaactcacttagctgaattaaggacgtgttcttaaaatctaccgccaacgtaatggggaggagctcacggcgttcgttaatttattcattccgcaaatatgttttgggcagttacataccgaatagtagatggaggtgtgcctgctgtcatggagatagggtgatttcatcctgttgatcaggaaaactcctaggtgcttgcaggtaaatgtgccacaaagaaagtgaggaccaaaggttagttgatgtaaaaacaagtttgaaatgcattttggggtaatttatccggtcgcttcgggcattcctcgcggaaggcgtggtctggtgactcagaagccaacacactgcgggagtccagccgtcggccccctgccgtgtggcgaggcccagtgtgtcccctttgtaaggacagcacaagcaggagttaatggaccggccatccatagcggtggtggggcagggagccagtttccgaaagaaactcacgccgccgcaggagggccctgtgggatgctctgtgcagagctgttgtgcggaccgggagacgggaaagcctggtggctgcaggagggcaccgtgcagaagtatccagtaaaccacccacagcacggcagcagaaaaacgaggaaattatatgtgtgtatgtttataagaactcagaagcaatggtgagcaaaaagcaaaagcaagaggagaaagtcacagtgtgctggcatcaagttgcattgagaggagcccgcggggtagtgcacccgcatttcctcgttgcgttgagaggcgcccgcggggtagtgcacccgcatttcctcgtttgagaggcgcccgcggggtagtgcacccgcatttcctagttgccttgagaggtgccgcggggtagtgcacccgcatttcctagttgccttgagaggtgcccgcggggtagtgcacccgcatttcctagttgccttgagaggtgccgcggggtagtgcacccgcatttcctcgtttcattgagcggtgcccgcggggtagtgcactcgcatttcctagttgccttgagaggtgccgcggggtagtgcacccacatttcttcactcgtttagagttcggggctctcagaacacagggagaatatgggagaattccttactagatgttacagaggccacacagggccacttttttcttttttttttattgtgtcaggtatacgtaaatattcctttcggtcagttcagcacgtaggactgagtggcattaggtacgctcactgtacagccaatgcctccataggccactttttaaatacgcggggctaagggccaacgacaagattgtcatcgaggacaataagtcgatggcgctgcctggtcactggcttggtcagaaaacacatgccagggtgactggatttaacgttcagttttagaaccacaaatctgccagcccaggcattcaagaggaagtgagtaattcactgaattgatggttagcaagacccttcaaagtccttggaagttccgtgtttgctgggggtcacaacagcaattgcgtttctaaaacattgaaaaccacccgtttttcacacatctgaatagcctgagttgtaacagacctaagtaaaggcgtccaaacgtgcctgatcctgtggctgggtcccaggagccttaacaaggcattgagagagctggattgattgattagactcttgccaactgctgtgcggaatacagaaaatgcagctccagctctcaaagggctgaaaatctaattgaggtgaaaaaggtaacatgtgtgaaaaccatgtctgtgtagacttgttttgtatggaccagaaaagttggaagtccagagatggatgcgaggaagtaggggatggagtttccttataacctctggagggacagtccagatacataccggggtgtgtagcgggtggaggttctaagacaggctggaggaacagtgcagacacacaccagggtgtgtagggggtagaggttctaagacagtctggagggagagtgcagacacacaccggggtgtgtaagcagtggaggttctaagacaggctggaggaacagtggagacacacaccagggcgtgtagggggtagaggttctaagacaggctggaggaacagtggagacacacaccacggcgtgtagggggtagaggttctaagacagtctggtgggagagtgcagacacacccggggccgtgtagggggtacaggttctaagacagtctggtgggagagtgcagacacacacggggctgtgtcggggatagaggttctaagacagtctggtgggagagtgcagacacacaccagggcgtgtagggggtggaggttctaagacaggctggaggaacagtggagacacacactggggagcataggggtgcttttctctgagtcccctagtacatggtagaggctgtagaccctccgctcttgggcacgtgggtaggctctcaggatgactcttggctcttgggcatgtgggtgagctctcaggatgatgcccagccccaattttcaggcaattgtgcaaggacttgacccattcatccgctgagctgagttgctgagactgctgggtgcccgggtggtgatcattgtccgtggcatacagaacacactgcagcttctgcaaagtgagctcatttcacgcattttatggctttgccaggctgctgttgacctgccagaacttttaatcagacatttggaggacctgttttgtagtcagtggagaaatattacaaggatagggtaatttgaaatatctaaggattgtaagtgacaagttcatgtctaattttgcatttccagtgaaagcaagtgttggctttgaatgttacttatgtgctgagatgtgtatattcctcagtgcttaattactaaggatttttagggccaagttttgttacagtgaatgattgtggatgcataaagaataaatttaatatttttaaggcatggagattatttgtatctaagaaaccaggtaaaataaagaaacatttatgcttgtgtgactgataaaagagttagagagacactcatattctgggagtttgaagaatgtcattttcattctctaaaagtcttgttagtgtcacagcattgaaaatttaaaaatccgtgtgtattttcttgctagtgctggtacttgaatatctgtatcatccacctatccatccacctacccatatttctataatccaccgtccctcgacatgcctatcatctgtccaccatttctctctgtctaattttcaaaacatcctgtaagtttatataaaggaagatttttcttcttgtgaagttctctaaggctgacaagttacctggcatgactgtggcggatgcccatagccaggtggtcctcggggtacagatggggcaggggcacttgtgagaaacacctgaagtgcttttccccagcctccccggccctgccgggtggtggaggcgctgcacggtgccttccatggagcaagcccggggctccgcagggtcctcagcatgattcagatttccttccacccccagctctagatgatttggtaaaaccacaaacaggcacaaaacagcccacatggaattctaaagttttaatttcattttggaatttatgcactcagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaaggttgagagaggttttcttcaactctattccaaaattatttttgctttgtgctaataagctgtcgttgtccagcaatactaatcttttggatcgtttggagtaattcccttcgcccagagttcttaaccggggtggatggaggccttcgggagagtcacaccaatgtggaaattgtatgtaaaaccttaacagcctgtcttaacagcattttcttaggaaagagattcatacattcattagaccctcaaatggatccaggacctcccaaggggttaagagcaactcctttagcttacttttcctttcaaaataacggtatttaatttcagatagtaatagttaaagctgaaaatatttacaggctaggcacagtggctcacacctgtaagcccagcactttgggaggctgaggtgggaagatcgctggaacccaggagttcaagaccagcctgggcatgatagtgagaacccatatctaaaaaaagaaaaaaaaaatagctgggcacagtggcatgcacctatatagtctgagctacgtgggaggctgaggccagaggattgctcgagcctgggaggtccaggctgtggtgagctgttattgaggtgctgcactctagcctgggtgatggagcaaaaccctgtttc

SEQ ID NO: 6769 - DNA, 477 bp, Homo sapiens
actgagtgaggcaatggcaaaaagaagagctttacttttttaacctttgaggacagccatgactctgcgaataagattgtctctcagaaataccgtaaagtacatagccactaccatgaagtatggaaaaccatgttgaagaaagaaatggttagtacttcagccagccagagaggtcagagtggttctggaaactttggtggtggtcatggaggtggttttggtgggagtaacaactttggtcatcaaggaaaaatttcactggtaatggtagctttggaggcagctgtattggtggatatgggggcagcagggatggctataatggatttagtacttaaatgatggaagcagttttggagatggtgggaactacaacgattttggtaattacaacaaccaatcttcaatcaattttgaacccatgaagagaagaaactttggagacagaaactctggcacctaaaaaaaaaagaa

SEQ ID NO: 6770 - DNA, 472 bp, Homo sapiens
cagggcctgaggctacctcagaaatatctcctgtgtttctggtggtggcgtaaaggggagagccggtgagaaacactgcacctgcacctacggggtgggtacatgtgactttgggcaagtgacttgatgttgtagtttttttcctaattttgtcttgacgtccttctcaggagagagtggctgtaaactctagccctgccctgacggggatcctggggatgtggtcgtgggtgtttcccatgtgcctttcatgggatccttctttgacctcacagacggcctgattcctgagtgtccaacctgtggccaggtgtccctctcgcaggaagcttgtttatcctggcacatgaccttgtggctctcatctgacctgtgtccagtttattcctactgagacagccactctcccggagagccctgaccgggaaagaagttaggatggggtagaggaggcaactcatcagaacccaag

SEQ ID NO: 6771 - DNA, 468 bp, Homo sapiens
gtcaagaaactgctgtgattcttcccctctgcctcttctatggaaaaaagctttaatctctggggagaagggtatctctgttggccccattggtgaacattcagggggtagatgagaagtgggagagaatcttatgcctggaggaggggccctgagcccaaaactgcagtcgggagtggtcaacagaaccgagagtgctgccctcctgagattcaggaacacagtgtttgacttagacttaatcagaacatcagactgtatcccccacccccaaccccctgccaccaagctaagaagctttcagtaacaagtaacccacaaaatactactaggaaaggaacaagattatgcaaagaggcacaacacaaagaatcaaacaggcattgctctagtaaaccatcgcccaccagagagacaaactgttctgcagattcatgaaggctgtaatacactgaggataactatggc

SEQ ID NO: 6772 - DNA, 210 bp, Homo sapiens
tacaggtgtgaaccatcatgcccggcctgtaaataaagttttattggaacaaggtcacacctatttgtttgtagattgtgcatagttgctttcatgctgcaagagcaaagttaagtagttttgcaacagagacattttggcctttgaaacttaggatatttactctctggctcttgacaggaaaagtttagcaacctctgcactaaagag

SEQ ID NO: 6773 - DNA, 329 bp, Homo sapiens
gggtgggtaagggacatttcccttcatttctctgcttgccacccttggggcctccttcagttcacattttactcagtctcccggtggctgtacagccgggggcgggggcatgtgtggacatccacacacagcgctggttgtatcctaaccaggaaactcaaagcagccttgcccaccacagtgcgttgaatggtgaccctctaaagatgtgtcctggggggctgaggagggaggatggcttgagcccaggagattgaggctgaggctgcactgaactgagattgtgccactacactccagcctgggcaacacagcaagactctgtcgca

SEQ ID NO: 6774 - DNA, 381 bp, Homo sapiens
tttttccctgagatggagtcttgctttgctgcctaggccgaactgcagtggcgcgatctcagctcactgcaatctccgcctcccgggttcaagtgattcttctgcctcagcctcccaagtagctgggactacaggtgcctgccaccacacccggctagattttgtattttttaaaagagatggggtttcgccatgttggccaggctagtctcgaactcctaacctcaggtgatccacccacctcagcctcccaaagtgctggaattacaggtgtgagccaatgtgcccagcccagagctgttcttgatactcacaagctcagattgtgagaacctcaaggccaggatcaagaatggggtccctgccataccctcgcagtgc

SEQ ID NO: 6775 - DNA, 323 bp, Homo sapiens
ataaccagggctggttgatgttacatctatttctgatgtaagaaatctaagagacgtagttgttagtttccatgccagttcttacctggtgtgtcacctgaagcaggtgatctttcctctctgtcctctgtccctctttaaaatgggaacgaatgtcggttgacccagggcagaggtcactgaagggctcactgctatccagggatgcacaccctgtttatggcaaagaagtataaaattaataaatgttgatttgctgtatgtgcagagaagtataaaattaataaatgtttatttgctatgtgtgcaatgctaaaactcta

SEQ ID NO: 6776 - DNA, 592 bp, Homo sapiens
atatcaggttatttgaatcaagtaatatttgcctatctatttatacattaatatgtttaaaaagaaatttctccaagaagaagcattcgtcattcactatttgtttgatgagatgatacttacattcttattgggtaatcataaaatagctaattttgtcgtgcttaatgccaagagcagatgcactttctaataaaaacaacatgcaaagcccaaatctaagcattatgtagaagcctattaaaatcttggagtattttttttgtaatttaaaaacgtaattgtggtttgcattgtgcccagttttcaaaaaagtatgtgattggtgccacagcttaaaaaccgaagaagcaaaaattgtcccttatgtttttaagtataatgagtcattttgagagacaatgtcatgcctagaggtttagtgcatacctctggcaccagactgtctggattcaaatcttgactgggcatggtggcttatgcctgttatcctagccctctggaaggatgaggtgggaggattgcttgaggccagcagttcaggaccaacctgccaaacataactagacccccatctcttaaaaaaaaaaaa

SEQ ID NO: 6777 - DNA, 1282 bp, Homo sapiens
cacagcatgagaaatcactgacctagactgatgtcttcatttcacagttgagacatccaagccccagagaggaaagggacttgaccaaagtattgcagcctgttaggtgcagagctgagcctgatatcctggtctcttggcctcccatttcctaccacttctcctgtcctgtaagcagctcttgagatttaggtaccttggcccctgtggaatcaaaatccctagacactgtgcactcttttgaactcatcagagatttttttttagtccctacgttctaccttgctgttgagagtgagctgttgccatgtcccttggcagcttccagcctagctagggatgtacctatgaagtagtaggtaattcaggctgtagagtctgtaataactttccatgcctatgtcataggattctaatttgttcaggcccagcaatacccaggagatgacattaaaaggtgttgattttattgagggtcagtggatgagggagaaaaagttttcaaaaattaaaaaaaatttttttaaaggtgttgactttagaccacaaaaagagtttgagagagcaagcagaacctgtcaagaaagacttcctaggggaggtagaagttgaacaggatcttagatgacttacatcagaagcagcagtcctatcaggaggaataccacaagcaaaggcagatgaggtggcaaagtccacatccaaccccagaaagtcttcttccccacccatgtctgcatggggccccaggaggctgtccccttcactggcccacccagaacccccatccaggaggaagatttctggagcacaccttttagccatgcccacccgcttccgttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaaaaaaaa

SEQ ID NO: 6778 - DNA, 1825 bp, Homo sapiens
tgtatgcaaatgtagcggcgcggcgggagcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaaaaaaaa

SEQ ID NO: 6779 - DNA, 1586 bp, Homo sapiens
tgtatgcaaatgtagcggcgcggcgggagcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctggtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaaaaaaaa

SEQ ID NO: 6780 - DNA, 1217 bp, Homo sapiens
cacagcatgagaaatcactgacctagactgatgtcttcatttcacagttgagacatccaagccccagagaggaaagggacttgaccaaagtattgcagcctgttaggtgcagagctgagcctgatatcctggtctcttggcctcccatttcctaccacttctcctgtcctgtaagcagctcttgagatttaggtaccttggcccctgtggaatcaaaatccctagacactgtgcactcttttgaactcatcagagatttttttttagtccctacgttctaccttgctgttgagagtgagctgttgccatgtcccttggcagcttccagcctagctagggatgtacctatgaagtagtaggtaattcaggctgtagagtctgtaataactttccatgcctatgtcataggattctaatttgttcaggcccagcaatacccaggagatgacattaaaaggtgttgattttattgagggtcagtggatgagggagaaaaagttttcaaaaattaaaaaaaatttttttaaaggtgttgactttagaccacaaaaagagtttgagagagcaagcagaacctgtcaagaaagacttcctaggggaggtagaagttgaacaggatcttagatgacttacatcagaagcagcagtcctatcaggaggaataccacaagcaaaggcagatgaggtggcaaagtccacatccaaccccagaaagtcttcttccccacccatgtctgcatggggccccaggaggctgtccccttcactggcccacttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaaaaaaaa

SEQ ID NO: 6781 - DNA, 1872 bp, Homo sapiens
tgtatgcaaatgtagcggcgcggcgggagcgcgcggctgatacccgggactgggctgcggcggttagtcctctcccggccgccgtcgcctccgacatattgcccgcaggagctgcggcggcgaagcggagagcaccggggggaggagatgggtgagcagagcggctcaggctcggcctggcaacgagcgggcgcacgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaacaaaaaaaa

SEQ ID NO: 6782 - DNA, 1438 bp, Homo sapiens
tgtatgcaaatgtagcggcgcggcgggagcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatgtgagtctcctccccggggaaggagggttggggcctgagagggtgggaggatctg

SEQ ID NO: 6783 - DNA, 390 bp, Homo sapiens
aactcactgcatatccctgaacatttaaaatggaaagaagaaaattaatgtttaattattatatgtgaacaaggaatgtgtttttacttaatgtttagtatattgtttatatttaatcacctgtgcaggaaacttaagtttcatcattttataagtaagagtaatatagctcagagaaagtaaatagtttaccctaagtcctacctaagtggtagagctgggatttgaacccaaggttgtttaactcattgcaccctcccaacccctacaggcttgtagtgtataacatacagttgtgttccatgccaaaccatagtgatttattttctgttatcatgatatatatctttgcgtaataataaatggcactcatgacttacacttagtggt

SEQ ID NO: 6784 - DNA, 216 bp, Homo sapiens
aagtcatctcagaaatattagtttataaatatgcagatacaatttctagaatgtcaaaaaataatcctttcacctgagttgtcttaagtaaataacttttaggatttttaattggattatttatgtaatcattataaaggagatctgaggtaaattgcttaagcattttctttagctttttgcaagactaaaaatggagaataaatatttgctcaa

SEQ ID NO: 6785 - DNA, 359 bp, Homo sapiens
taatgaaaaccatctcaagcaatttggaaatgaagtaccacatgtcctatgctgtcccttccataaacttgacaaaacagcctataacaaattgtttactttgagatttagtaggaaaattccatgagatttaaatgagatgactactaataagccatctacatttgattctattccaattaaaaatgggttaggaaagtgctttgaatatcaagtgtgttcatcagggaatcatttacctaagtcttcctaacactgtttagtgaatattaagcctgatgtagtaaatacacgctaaccactaaattgaaggggaaagagggagaacaaagaggcatgtaaagtacacttacttcttc

SEQ ID NO: 6786 - DNA, 395 bp, Homo sapiens
atttttttccacatagttatacacatttgtgctacatgaccaaggtgtgtgttttaacttggaacttagggtaatataagagtcccagatttcttcaatataaaagatcaagtcaaagtctaatacatttaagatccttcataactatgttttaagtgagagttcactcataactagtaaatgtatttgatgctgtctagctttacataaagtagctctccaaaacaaatctggtattactggaaattatttgtcagaaacataaatcaaattctattaatgccatatctgagggcatttctgattttctaagttgtatatctgcaaatacttacgtttcaataaatgccaaatccttataacaatgctatttattctcatatcaggtagagatt

SEQ ID NO: 6787 - DNA, 419 bp, Homo sapiens
gtcgacttttttcttttttcctcagctgtgtggacggcagtctcaggggttaacagcgtaaaatagggttcttcccaggctggtttgagttttttctttctagcttttgatgaggacgtggttttcaggctggtgctggtgtactggaaattctaggggtggtacctgtgctaaaagacttttaggtccgagggaagtgaaagtggaagataaattaagtataggatttttgctgcatattctggggccttaggcgtcatggtgacacctcctgctccattcttgttcagcgccacccaggggaggctgcagccctgccccttcttaatgtcttggccttcttgtggccttcaccacccttgctcactgtggccttcaggatgaggggccttgtgacttacctggccatcttagggcct

SEQ ID NO: 6788 - DNA, 387 bp, Homo sapiens
atcctcagatggctagtggagaaacagttcagagcccagatcatgctggagagcaggagagccttggtgaaagatgaaatggcaaaatgcttaagagttggggatcaggaggcagacacacccacatttgaagcctggctcccccatttgctctctaggtgatagagcaagttactaaccactctgagcttctgttatttctaagagtagaagaaataaaaggaatagtgccccattatttgtaagaaagtgtgaatgacaaggtgcatgtaaagcattccacagtcaatattagcgattgtcactattatttgtgtatacaataaacagcactgcccatggaaggctctaactctagagtccttcccaaccctgtctctatcactt

SEQ ID NO: 6789 - DNA, 445 bp, Homo sapiens
tttttgcttatgtaaaatgctacagtggataacatacatccttgctcccaaagtacaggaagaaaatttatatcattaaacacatgcaaatgaaaacacaggattccatgcttatcatccaaaccacttacctgattcatcaaaactacttgggtagtagaacaaactattatatcttcccagaatattatggaaaggtatcctctattgctgaataattgagtctacttttcattttaccaaagttgaaaccaagaaaccatcatcccttgatcctgaccccagtgctccccaactttggtggacagattctgcaaactgtctaccaaactagtgagataacagatgcaatgcactaatctaacttcattcactcattcattcattcattcattcattcaacaattgtgtatttgctaagcacaaggtaataaggaaagttcta

SEQ ID NO: 6790 - DNA, 473 bp, Homo sapiens
ttttttttttctttttgagacagagtctcgctctgttgccaggctggattagaaactacctcatgaaaattagcatgaccttcctttatgcttctctggtttgtattatattctctattgacaaattttaaaatattataattcattgagagtaccattttgcctccccctactccctactccaaatatgagtttttcctgtttgattaaacagccattgagcatctgtcacagatccagctctgttctaggtactttagaataaagatgaatgcttggttgtttccaggctatgctgtaaattctaaggaagggggttaaggacaggattcttggaggcagtatgatgtgatcccagagacaggagataggaaaaagataagcacatgttctagatgtgtttaaattctcatcaaataggaggcgacgccattctctgatgaggaaggagatatgaaatcagacacccaaag

SEQ ID NO: 6791 - DNA, 513 bp, Homo sapiens
atgtggtgtgggcttaggtccccacagtttacctcagaaatagtcaagatgcagggagctgaatgaggactctcgaggcagctttgccagcctggagcccaggtgagtcactaccacctcagaaacatccttcagaggccaggattcaggccccaggcgggagtcggagcatccaggctgctggtccggttctctccactgacgtcatcacccccgcttagtctggaatggctggcaacctctgcctgaggatgagagctggctggaagtggaaaagcaggaaatgtttccagattggaaactcaaggcacgtttgcgcaatactgcactcggccaagactgtgtggctgacctgcatgcctaatgggatcccaggtctgaaacagggttctgcagaaccattggtctgacctcatacctcccacctagacacaatgatatcttcttggccaagaaaaaatgacctgtatttttcttttcttttttaatgttatccagctgaggtgtgccttt

SEQ ID NO: 6792 - DNA, 371 bp, Homo sapiens
gtatgaacacagttttcctttaaaagaaaattttaaaaagaagtagctttaaaccacctatgtttgattaggaattttagggtcccgttttcctctgtgtgtttgtgtttgtgtatctaagtcactacaaatatatacatatgtattcaagatcaagttatgaatttcatagaattgggaactttgtcggttttcttgttttaatgatgttgagtgaaaacagaaaataggaggacattcttttaaaatagccttgccgaaaacctgaaaaggactctagcattcaataaacagtacatttctccctcattgggggtcaatgaatgtttaatgcatggggcaagattttggtctgatctgcaaaaaaaaaa

SEQ ID NO: 6793 - DNA, 780 bp, Homo sapiens
agagagcggcgtctccagttaggcgctaatgctggatgaattagtcttgaagtggccactagtaggtctccttgtgggagggcttagagccagatggggagcccaggccctgccctcattttaaaatgagcccctggcactcccagagagaggcattagcaggttacagaatgaagctattaaataataggtgtggcattaataataggtgtggcagtgtttcttgagtaatttcagagctactcacaggttgacagatgtaccctaaggtgctttctttaaaatatatacatagagagagaaaacaattttttaaatgaacttttgagttcctgagatccaagaagggttaaaagttaatgttattttgcccatatatactggtcttagggctttatttctgccctaaaaatattctacttaaaaaaaattcccgtcatcccatttatagtataaaggaaataatgtcactggattgtggaattggggctagaaacttgtctttggggcaatattgaagcctatggaagccagaaaatgtctagttggctaaaccaaaggatatatgaaattaatagtttgccgaagacagtttttaaaattaaactgtggtgacacatcagtggatattcagctaagtattttaaacacctgtaagagaagaatgtaacctattttggtgcaaaaaaaatattggaccatctcttacttgttgaaaagcctaagccgattcgtgaaggtcctgttggtgcaggtgacagtcttgccctgaggcctaga

SEQ ID NO: 6794 - DNA, 351 bp, Homo sapiens
cttcctttatggcattctacttttatctgttgtaggctgttagtgtttcatattcgatttggtttggggaaaaatactcagttaaaaaaattttttttaatgattggctttagagggactgttacctctttggcatatctgtcagcggaatggaaagaaatggagtcagactgaaattcatgccagcttaatcactgaaggcagcactgctttgaaaagaagaattttcaacccacatcgtaaaaacaaagcctgattggaaacaatgaagtgtttgaaacttaggggcagcatgtaagtggcttaatgagcaaacaaacggaacatactcattttatatttaaaaagtac

SEQ ID NO: 6795 - DNA, 283 bp, Homo sapiens
acaggccctgctgacttttcccgtcatctcttggccgatgcagctctgcttgtccccacccccatcccccttttgcccaggctggccacgccccacagcagccccacttccagctgcgttccctcaggatcaccaagttgctttccactgagtgggctttcctgtcaccttccatcctgtcaccggaaaccagccatcctctgtttaggtctcccgtgctccctgcagacacctaatgcctgtctccacactggaccgccgcatcccagttaccgaatcacct

SEQ ID NO: 6796 - DNA, 469 bp, Homo sapiens
  misc_feature (16)..(17): n is a, c, g, or t
  misc_feature (20)..(20): n is a, c, g, or t
ctaaattcgcggccgnntcnacctcttctgcgtgtgtctgtgtcttagtcttttctcataaggacaccagccacattggattaagacccacacacatttgttggggtgcagggttgtcttgtgcattgcagaatgttaaacagtacccctggcctctaattaatgaatgcctgccatgggtgccagcgcgcagtggctcacaccagtaatcccagcactttcggaggcagaggcggctggatctcttgaggtcaggaatttgagaccggcctggccagcgtggtgaaacctcgtctctactaaaaatacaaaaattagctgggcgtggtggtgcacgcctctaatcccagctactcaggaggctgaggcatgagcatcgcttgaacctgggaggtggaggttgcggtgagctgagatcgtgccatgccattgcactccagcctgggtgacagagcgaggctccgtctca

SEQ ID NO: 6797 - DNA, 437 bp, Homo sapiens
  misc_feature (24)..(24): n is a, c, g, or t
  misc_feature (53)..(53): n is a, c, g, or t
  misc_feature (57)..(57): n is a, c, g, or t
ctcgggtgatccgcccgcctcggnctcccaaggtgctagaattacaggcgtgnaacngtgcccagcctgtttttgttttttgtgttttgaagcagggtctgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctca

SEQ ID NO: 6798 - DNA, 812 bp, Homo sapiens
gttggaacctggaatcgtacaatttctccagtttccacggagtcctgggttctagcctccagtgacacatagaaatatccttctgaccacttgctctttaaacactttcctcatgggaacacacagttgcagtttttgttgttgttgttgttgtttttgtgtgagtgtgtgtgtgtttttttttagcatccagtatagtccttgctgtaggtgcttactcagtgtcaactaatggttttcctcttagtcttttctttccttggcacctcctaaaagttgagttttccaggattcctttcttggccctctttttactcagggtacttttcggttgacattcatgcctaggcctcccctaccagctgcgtacaccccataccactgtcttgagccacagttgaaaagtgcttcaaaagtagcaagtatcttctaccttttaaattccatttcgttcaacagctatttattgaacacctactatgtggcaggccctactaggtatggttcagaatatttccccctcttgtgttttctttaccaatgatgacaaaaaaaatcaatataccatcatccacagagaaacttgggagtccttgtcggctcaaggactttctctcatccccctcccacatggaaacagctattctaatgattttacctctgcaatctgtccacttttctaatacagccgctgccttatttcaggcctttcacttgaccggtatttgaactgccaatctcatcacatcattcttgattcaaatatttcagtgtctccccattatcttcagaataaagaccaagctctttat

SEQ ID NO: 6799 - DNA, 423 bp, Homo sapiens
ggaggctcatatattgctgcagtttctgtgggtcaagagtgtggaagtggctaagcagaatgagtccagctcagaatcccatgagtctgctaatcaagctattttctggggttgcaatcatctgaaggcccagctggggctaaagaacgcactttgcagctcgctttttgcctggctcagaagatccatttccagactcacttacactggcaggcctcagttccttgccatgtgaatcactgggatgggctgcctgggacctcctcaggatacagcaattgctaataaaagaggtttaaggggaaccagagaactagacgataaaagaagttggctaacatgaaagccccaccttccaacattgggaatcacattttaacatgagatttggaggggacacacatccaaaccatttcagacccc

SEQ ID NO: 6800 - DNA, 244 bp, Homo sapiens
aatagtagctacctcacatggtactcataaagattaaataaagtaatttaggtacagtgagataaggcttgccttccagcagatattcaatatgtgttggccattattattatttctctaatcattagagaaaagaataacaaataataagaaatatctgcctacagttaaagagacatttcctttagtcacctctggctaaaaaaaaaattaaataaaaaagactaatgaaagcctgaaattc

SEQ ID NO: 6801 - DNA, 280 bp, Homo sapiens
tataaaactcacacatttatatataaactgcattgcatagatttgaatccagaatttctatttaacattatacaatgaaaattttaatataattaatattgtttaaaattaaatttatatagtatcatctcaatgcatgtgccataatttatgtaatcaatttcttactgctgatattttgttgtaaatctcactgcagtgaatatctttatagagaaatctttttgtacatctctatttcattatggcaatttttcagaaataaaattatttaaagtac

SEQ ID NO: 6802 - DNA, 434 bp, Homo sapiens
gattagatagaaataaacgggacataaaaaattgataaagttaactgataatgttaacatgattcataatatcataaacatttgcagatgaattaatcttgcatatagaaaatcctaggagatccactaaaacctgtttaatgaacaacttcagtagagttgcatgataaaatatcaatatgcaaaaacatattgtatttctatacagtagtaatgatcaaacaaataatgacatttttataactgcaagctcatcaaaataatttttaaaactaaggagtaagttttaccaaaaaagtgcaatatttgttcactgaaaactctaaaaattgttgaaaggaattgaagacctaaataaatggaaagacaccccatgtttatggattgtgagacttaatattattaaaatattgataccagctaaattgaaaaaa

SEQ ID NO: 6803 - DNA, 365 bp, Homo sapiens
cattctctgtaattaattttatcagtaaagaagcttgataatctgtcatttttatggttttaaaatagtttttaaaatgaaagttggaaaatcattattcagcagcctggtgcccaaagtgtgaataacatcttttgtctaaagcaaagtgaaatggttctcatgtcttcagcagggaggagggaggatgaggatgaggatgtggatgtgggaagaccaccagaaatctgggttcaggccgggtgaggtggctcacacctataatcctagcactttgggaggctgagataggcagatcacttgaggtcaggagtttgagaccagcctggccaacatgctgaaaccccatctccactaaaaatacc

SEQ ID NO: 6804 - DNA, 349 bp, Homo sapiens
cacacccactcccaatacactctggagcaaagcagtgggtctaatatgctaatactgacctatggttcctaaatctggctttgcttctgagtcatcaaggaaacttgtcaagaatacagacttcaggctcctatgccacagaaggcctgggttgagacctggacatctgtatttttgaagctgtcctaatgattctcatagagctgtgcaaagactgaaatttgagaaactcttcggctgagcacagtggctcacacctgtcatctcagcattttcggaggccaaggtaggaggattatttgaggccaggagttcaagaccagcccaggcaacatagtgacacccccgt

SEQ ID NO: 6805 - DNA, 773 bp, Homo sapiens
ggtaggccctctgggcgccaactgctcctctgtctcatcaggcagtgtcccctgtgttcctgacctcctgaggagctgctggatggcttagccccttgacactggagggctgaccatgagctaggcaccaccaatcaaatgcacataatcaagactttaaattggaaactagtgatacatcaaagcagaagtcactcgcaatgggaacaactccatccagcttgctgatgcatcagtggcagcagattcaagggtggtttccagcatctactgtcagtgtggcatgaggacaagcttcagtatctgcacccagcaggagcagcactggattttcaccaggccagttctccagcacaatttgcatattgttcctggcttcgtagcccctgagcctggcccctggacctttctggaaattctgtgagccagggccagcttcatagctatgcaacctgtgccatcacacaggaccccaggttcagcacggccctgtgcttggtttaatgctctgctgttgccatcttgcaattcttacagttcttttaacaagaggcctcacctttccattttgcttggatcttgaaaattatgtaaccaatcctgctatgagctagctaatatgctttaggtcagggagttcttaacctcttatgctcatgagcccttggtagtctggtgaaacctataaagcttaggaggaatgtttttaaatgaaatgcacaaaatgaaatacataggaaaccaattatattaaaatatagtttaaaatttaa

SEQ ID NO: 6806 - DNA, 575 bp, Homo sapiens
aagaaagcctacagagggcagctttctttgaatcccatgaacgaatatgacaaaaaaaggctctgacctgagcctctggtttatctagttgtcctagagagaaggatacagcaggctcccaagaagaagccacatttggggcagagcagctctgcacctttcacatttttgcccatggtttcctttggaagggaaaagctgaaatgcaaaaggagaagagagctggacgcatcacatagttttaattggtttcgaagggtcaccaagcagaatcctttctgtagcagaatagcttttccttgggagctggtatggtcagagaagaatcccggcccaagagctgaaccaggggccctttggggaaagggcctggggagtcccaaagcggcactgtccctgctcggttgcaggcagtgaccctctccccacacccgactcagtgccagctgtgtcctgagtccaaggtggtacattaggtgcttaatgtttatcccttaacaagacaaacattaacagggtggtcgctcttaaaacatggccttcccattccagtgggaagacagagaaaacaagtt

SEQ ID NO: 6807 - DNA, 436 bp, Homo sapiens
cagaccaccacaataaagccagccatatgaattttttggtttcgcagtgcacgtataagttatgtttacaactatactgtagtctactaagtgtgtaatagcattatgtctaacaatgtacacgtgttaatttaaaaatattttattactaaaaactgttggggcaaccaaagtggctcacaactgtaatcccagcattttgggagaccaaggcttctgccttggaattcaagactagcctgggcaacagagcaagactctatctctacaaaaaatattagctaggcacggtggtgtacacctgcagtcctagctactggggagcctgaggcaggaggattgcttgagcccaggagctcaaggttgcagtgagctacagttgaaccactgtactccagcctcagccacagcgcaagaccctgactccggagggaga

SEQ ID NO: 6808 - DNA, 958 bp, Homo sapiens
gtcctcaagactagaaagcatgaagcaggggaggcgttttgaaagcttaaggacaaaagaccatgggcctggatggctgattccgggatcggcatcgtaatttgttgagaaggaggccgtgctgtgctgccagttattaatgggtttaatcggttgatacacagccctactggcctaaccagtagcccagggcccgagaggatttgcaggtcgtgtcagaatttgattgaagttccttccacttggcataaggagacaccatcagcctgattgagagggtcatggtgagatggagcccgccaaggtggcagcgctgagctgaccacgccacggaccatagagtgggagcctttcctgcccccttaaccgcagctaacatcaaaagcactggtatgggctgtctaactggaacctgagttggtctttgtaattacgattcttttgggtttattttgccagttcattatccacccccctgaaatcaggcctcccaaatttagcaggtgctggggaggaccccagggagtggcttgtgggggctagctggtgaaactaccctttcctttctgttctatgagtgtgatggtgtttgagaaatatggggctatggttcaggcgcacttcacatgtgcaaagatggagaaagcactcacctgcacatttaggctcagaatattgattgaaacattttgaaatatcaaaaataaaatgttatttttaaagtttctctgagatttcgcttaagttttggtagatattcttaaattttagtgacctcagtttgggaattcagtaagccaaatattgtatccttattattagttatatagaactatgccttagactttgttagaaacttctgcttcagcttgactgactcattttccatttctggttgtacaaaatgaactgacactttaatgctgtggccacctttaaataaagtacaatgtgacaa

SEQ ID NO: 6809 - DNA, 272 bp, Homo sapiens
gactgagatgcacaggtgtagggagggctgtgacctccttcgcgtcctttgtgggatgctggtcctctgtggctcctggcccccaccccttcctgcacagaaggcacagcttccttctgagtttcgccgcatgatttgcagagagaggagaaccacatggagagtgtggtcaagcacctctgcacaatatgatgttgaaaattgtctggccaacaaggtggatttgagcttcagcccatcacaaagtctcccagccgaccctatgcagtctc

SEQ ID NO: 6810 - DNA, 317 bp, Homo sapiens
ggcacgaggggattacagttgtgagccactgcgcccggctgcttatttggaaaggaaaatctttccaagatggccctaacacatactcccttgggtctcattgacctgagctggtccatcctcaaaccaattcctggtgaaaaagggacaggcttgctgtggttggcgctggttggctttggccagtcttgcatcatctgccaggactgggtccttagctgcccaaacaaatcaggattctgttggcaagcgaaaaagagagtggccgctggtagacagccaacagtgtctgctacagacggcaaaacacagagaca

SEQ ID NO: 6811 - DNA, 431 bp, Homo sapiens
cctgctgagtctgagctgaccgagagggaaaggagcagcaagaagtggttaagggacaggggagatgtaataatagggtcaacaaatcaggccccttgtggggctgagaattgttgcttcaggatagctagagaaagagctgggaaggtggtgtggtgggacgctggcagttggtgtgttctggtttcgtgggatagtggaagtcactggagtgatgggggagggggattcttggtgattaggagaacagggtacttcctgtggggcttctgagaacaggggcagtttttcatgaccacaggactgcatttcaaggacagggtctgggagtcacggtggctcaggcctgttgtcctggtgcataaggaggcgaggctaggctttcgaggccagcctgggcaacatagaaacctccaatctgtataacaaaa

SEQ ID NO: 6812 - DNA, 605 bp, Homo sapiens
actaccgcagctattcccagataattctacccactataaaattgagaatctcatattaaagggactctgcaagtgagggaaaaatgttttgtcccccattttttaaagcgcttgataagaaacttgttatcaattatggagtacacatgttttctccttttttttttttttaaatcctaccctgtgggagttgcaatacagttgtattggaatgctttcttgtacaaacataagttttacttttcccttctcctggactctccagtcaactgacggttgggttacttctttccaaatagtacctggtagtgccccaaagccagaggtggatgccatcctttcttgagtgtcaactgacacattggcctgggaaaagattctaaactacaactaattaactagaggagagatgtccttcttagacttggaatcaacagctggttactagtaaaagaataacagtagtcattgttaacctgacaatcgtatttccactgcgcccggcctttttcttttcgtttctagtacattttggaaggactttacccctcttcctctttaaagcatccaagtcatgcattttctaccttaattttaccaaaaaa

SEQ ID NO: 6813 - DNA, 952 bp, Homo sapiens
actaccgcagctattcccagataattctacccactataaaattgagaatctcatattaaagggactctgcaagtgagggaaaaatgttttgtcccccattttttaaagcgcttgataagaaacttgttatcaattatggagtacacatgttttctccttttttttttttttaaatcctaccctgtgggagttgcaatacagttgtattggaatgctttcttgtacaaacataagttttacttttcccttctcctggactctccagtcaactgacggttgggttacttctttccaaatagtacctggtagtgccccaaagccagaggtggatgccatcctttcttgagtgtcaactgacacattggcctgggaaaagattctaaactacaactaattaactagaggagagatgtccttcttagacttggaatcaacagctggttactagtaaaagaataacagtagtcattgttaacctgacaatcgtatttccacaaaaacaactctgtgtaaaaaagaggcctggcacagtggctcatgcccgtaatcccagcgctttgggaggccgaggagggcggatcacctgaggtcaggagttcgagaccggcctgaccaacatggtgaaaccccgtctgtgctaggaatacaaaaattagccgggcatggttaatgtccggctaattacaggcgggtgcctgtagtcccagctactcgggggactgaggcaggagagtcgcttggacctgggaggtggaggttgcagtgagccgggatcacgctattgcactccagcctggacgacagagcaagactctgtctcaaaaaagaaaaaaaaaaaacccatgaaaaaatggccgggcatggtggcatgtgcctgtagtctagcggaggctgggatgagaggattgctggagcccagccagggcaacagagtgagaccctttctccaaaa

SEQ ID NO: 6814 - DNA, 253 bp, Homo sapiens
ataaagaatgtggttaatttattggaatatcctaagagctttcctccaaaagcttcaaggtacttgtctgattttttttttttaagacacgactgttttttacaatagcaaattaaaggaaaagtataaggccgggtgtggtgtcttacgtctgtaatcccagcactttgagaggctgaggctggccagttgcttgagctcaggagtttgagactagcctgggcaacatggcaaaaccccatctcagaaggaa

SEQ ID NO: 6815 - DNA, 258 bp, Homo sapiens
taaagtgggtatagaagttggtatgaacaataaggccttaatagagagataattaaccttgatagtatatgaaaaaacaaatgctggattatagagcatctaaaggatatagttagctacatgaatgcacaaacacttttctatttagttttgcttttggaaatatattgatattctacataataaaaaaattaaatctacaaggctgggggaaatgaaaactgaaataaattgtataactagatttaaaaagaaaag

SEQ ID NO: 6816 - DNA, 804 bp, Homo sapiens
tgaggagagataaagacagttgtctcctcactgtcagaccccagatgttacatgcagggagcctgctctctttaaggcagtcttggaaatggagcctggagggaggttgggcagggctgggtcatcctggcataatcccacatctgtgtgcatcatagcatggctggcaagggagtccaggagcagcttcctcgggcctttaatgcagctgatccaggagctccagcctcctgaaaaggggacaagagcctgactggggcacatctctgcccataccccccttcctagagcatgggccagggcttgtggaatagggattaacccagcagacgagaccatgaggagttctgtccatggtgccctcagcactggctggtggcagggttaccttggatgggctttgttcctggtgtcaccctcaccagctggggggctcctggaggacaggctctgtggcctattggtgtcagcatatcaattcaatccagcatatacttttgactcaccttatatttgttgacaacccatacatctatggccaggtgattttcaacaagtgtaccaaggccattcaatggggaaagaatagtctcttcaaaatatggtgccgggacacctggatgtctacatgcaaaagaatgaagttctaccccttcctcacaccatacacaaatattaactcaaaatagatcaaagacctagatataagagcttaaaccatacaactcttagaaaagaacagaggggcaaatctttatgaccttagattcttagatacgacaggcactaaaagcatacacagca

SEQ ID NO: 6817 - DNA, 938 bp, Homo sapiens
gacgtaatgttatttactgaaattcccattttatacctgtgttagtggtgcaaactcatttccatggcaactgaacgtctaggcaggaaaatagttctaagtataaagagatgaggggagagggttggcacctttgtttattgtttattgcaatgtgcaaaatccccagatatttagaggacattttgaggaaaataatcttaaatgtacaaactacgaatgtagtttgtaaatctttatcacttgcggaaagtaggtgagtaactggcagtaaaatcttcccaaacgaggccaggcacagtggctcatgcctgtaattccagctcttttggaagatcaaagtgggaggatcgcttgaggccaggagttccaagaccagcctgggcaacctagggaggctctgtctctataaaagatagaaaaatgagctgggcatggtagtgtgtgcctgtagtcccagctacttgggaggctgaggtgggaggattgcttgagcccaagagtttgaggctgcactgagctagcatcagggcactgggtaacagagtgagactatgtctgtaaaaaaaacaaaaaaacaaaaaaacttcccaaacagaccctagggagggggaataatgctttgaaaaatggaatatgattttagccaatacccgcagcatcttaaaagatccctctgaggacagctgtcagcttctccagatttggttgttttgtgggcttatgaggttgtggtgactggcaagtggcgggagcaagacaagatggacgtttggatcttttttccgtacctttattagaagcagagatgccatttccccattctcttttctccaagtcactgtaaaggcgttgcctcactcccaaagaccagtcatgttttccgtgtctcggtaggtgacttacaatagttgggtctcacggggtgatgaatgaca

SEQ ID NO: 6818 - DNA, 324 bp, Homo sapiens
tttttcaagtatttaataattgaatattttgaaaatgaatgcaatgcttcagaggagtaatattttgggatactgtaaattctcaacattcctacaaaatgaaaccaatacagtcattcttcaaatatatgctgaattttgtggtttgcaagtaaattctctttaaaagttttagctgcatattcctattgatttctttgtggacgacatgaatctgtatcactatatctttttagaaataggtacattgaaaatgaagatgaaatctatgcttactttgtacgtattgagctagtgaaatatttgatatattaaacataattc

SEQ ID NO: 6819 - DNA, 210 bp, Homo sapiens
gttgttgagtgctagctgttgttgagtgctagctgttgttgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttc

SEQ ID NO: 6820 - DNA, 262 bp, Homo sapiens
gccaatcaacaaacaaaattgtcctttgggatgtaacctaagtttatactataagtcaacagtccccaaccattttggcaccagggactggtttcatggaagacaatttttccatggattgggggcaggaggtggggcattagattctcataaggagcgtacaacctagatcccttgtacgtgcagttcacaatagggtttgtgctcctatgagaatctaatgccgctgctgatctgacaggaggaggagcttaggtggtaa

SEQ ID NO: 6821 - DNA, 454 bp, Homo sapiens
atgatgacagaggtcacaacatagtgtgacaggccacttccaccatccatccttgttctgccctgagtggcaggcactgtcccccttgagagataaacaaattgaggtaatttgtccaaagttgtgtttactgtctgcctcatgagcgttgagtgacctgacaggctgctgtgacagctcaggacagcacctgaccccagggtgctgggtggtcctggactgctctctgtggccgtcgtcatgggggtaccttgactcccaaggaataccatggggtactccttgggagaggagaagagagtgggtgacgggttcttgggcttggggccacacaggccacccccatccacacacggggacagatgggtcatcactgtaagaggcccaggtgcagctaacctgcatgttcggcatcccaggaaggcggtgggtcccctgctgctttcccccaagg

SEQ ID NO: 6822 - DNA, 2605 bp, Homo sapiens
agacagctggcaatgtgtggagacacttttggaggtggagggtggtgaggggtactaccagtatcaatgggtggaggccagggatgaggctaaacacccaaccctcatggattagtttgccagggctgccgtcacaagatactgcagacggggaagcttacacaacagaaatgtgtattctcagaattctggaggctggaagtccaagatcagtagggtttcttcttcggcctctctccttggcttccactcatggtgtccttgcatggtcttttctctgtgtgcacatgactgtgcaggactggtgtcccgatttcttgtagggacagcagtcattggatcagggcccatgcgtatggcctcattttacttcagttacctcttttttagatagagggccctatctctaaatactgtcacattctgagataccggcagttaagacttccaacatatttagtggtaggggttaaggggcacgctttagactacaacactccacagtaaagaattatccagtctaacatgtcagttgtgccaagactgagaaacctgtaatgtaaaggaactcccaagtctacctgaaaagtaaggtctaaagagcatttattgagcactatctgttagcacttagcatatgtttaatattcatacattgaaagaaatgtatgttcatatccatctgacaaagattaaggaacttagagtaagtaatagatccaaaattgaaactgataaacttctggttctaaaattcaccttttagtgaaaatacagtttctcaccaaacttacagtaattcagagttattaactctttctacctcctcactcccctcaaagttataacatctcccatcgacatcagctcagaatggcagtgatgcttatggtttgtgggggtgcaggtgagctgctggatgcactttagatggcctagtatgccaggccgtcctttcatcctctactctcgtctttctttttcgacctcatgttgaggattactggtctagttgaaaaaagaattcatacacataagaccatgtatataatagagggaggtatgcctttaaaaacaaaattatatggtaaagactgatgtgtcaacagggatagacaacatagagaaggctagaactgtttctggaaaaaaacccagaaacaatggatttcaaacttcttagcatccgataaaagaaagtagcaattattcaaatgagaaacacttctgtctgttatgtacatattatgaaagtatgaacataagagggaaaaccacaaccattacattttttaccatttcagtaatttttttttggtttttagtctgtttttagacatccttaagaacaactatctgaggctgtaaacaagtatttacattaacacccatgatactgactttatactccctacctgcattgagaccttaaagggggcatttctccattccttctgtgtatttctgggtatccccaggttcagatattcagaatacagatacaagtccatgcttgcatatgttgctgctccccccgacagacttctaccagcatctgccctcctcaccgctgctctgtcacgtgcactgcggctggccctgctggaaagtcctaccttgcctaggacgccatccccgatatagccccaagatgcaaacctgccaagtgctagggcagccctgccttcctgtccatttcagtctcttggccttgctgtgttccaagtggaaatgggagtgtgctttcctggtttgctagtgtactatcacccggaccacagcgtcctgtgcaaaaatttgcttcctctctcttcccctttcactctttctcttttctcttccccacccccttttttttctctttccccttacctttctttcctttccactcttcctgtccttccttccttcaactattaggactatatgtcaagtaatgtgcaaaacaaagacagttcctgccctgatggagcttgtagatcagaagggaagatgagcattaagtaattatatagattaatgtacaactgtgatgagtgcaacaaaagagaggttcatggcactatcaaacatgcaatggacggattttgtttttgcctataaactcttgccatagaaagcttgaaaatcagtccagggggacagcattaatcaccatgttctttccttatccctgtcttccccaaaattcatgtgttgaaacttaacaagaggtgggaactttaggatgtgattaagtcgtgagggcacagctcttatagatggggtcacggtccttctaaaagggcttgagggagtggttttgtttccttccatcccttccgccacatgaggacacagtcttcgttccctctggaggactcagcaacaacacaccatcttggaagcagagagcagtcctcaccagacacggaatctgccagtgccttgatcttggacttaccagcctccatacctgtgagaaataaatttctattgtctataagttacccagactgtggtattttcttctggcagcacaaatggacacccagaaactgatgcatgcatcttctgactcctttgattccaaaatacaaaatattagaataaagttatggaagtc

SEQ ID NO: 6823 - DNA, 884 bp, Homo sapiens
  misc_feature (23)..(23): n is a, c, g, or t
aaaataagaacgggtttgcccantttatgccctaaacaatgagtagaggtatattaagaacaaagttgactcaagaaatcaaatttgcttttcttttctttctgttcctgttttgttgtcactttgaaatatttttgttttgttttgaggtaggatttatttgcttactttattatcagagaaaggagcagatttatgtgaaatgttaagtatgctgatcataattttattcttgtgttaaggacttggaataaggacagttgcaaagttaactcaatttgttgatgtattgcctgtgttctttttctgaatgctgaagtaaaatattccagttttaaaagtatgccaattttcagtgggaatatattttatatgtttttgaataataatcaagtattttatttttttcctcctcgcaatgatgtctcaaggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtacactaagaccctttgatgaaagatagcaataatattaataattcaaacatgaataactaaaccaaaattgcacccaccaatcacatgcctatcatatagtaaaaaaaaaa

SEQ ID NO: 6824 - DNA, 966 bp, Homo sapiens
aaaaggaaaaaaaaaaacaaaaaaaaaaggacatttgggaaattaacatagatacaatgcttttatcaaatctacagaccttactcaaattttgccagttgttccaataatgtcctttatagcaaaagagcagaaaaacttttttttctggtctaggatctaatccatgatctcacattgcatttacttgtcatatctatcagaagtcacttgacatcagtttgtcccattattgctgatggtattttaatcactttttgaggtggtgcctgtcaggttattgtaaagttactatttttactttataattaacaagtatatttggaggagataatttgagatgatgtaaaaatcctctttctcatcaaactttctactagttttagcatctatcagtgattcatgactgaatcagttattacagtgatggttgtcaaatggtgattttctaattccatcatccattctgtatttatcagttggcattctattataagaaggtgcgggccggggcggtggctcacgcctgtaatcccatcactttgggaggctgaggtgggcggatcacatgagaccaagtttgagaccagcctggccaacatggcgaaaccccatctctactgaaaatacaaaaaatcagccgggcatggtggcatacacttgtaatctcggctgctcgggagtctgaggcaggagaatctcttgaacccaggaggcagaggttgcagtgagccaagatcatgccactgcactccagcctgggcgacaaagtgagactccatctcagaaaaaaaagtgctttcccttctctcttatttatttattcataccagtatgcactcatggattcttattttagtcaatgagttataatctgtcactgtcattatttaatatgttgcttttaaaatagtatatgaaataataaaactgtaacagtaaatggttattagattgcttacctaa

SEQ ID NO: 6825 - DNA, 200 bp, Homo sapiens
  misc_feature (36)..(38): n is a, c, g, or t
  misc_feature (56)..(56): n is a, c, g, or t
  misc_feature (65)..(65): n is a, c, g, or t
tgggaaatcttaagtagctatatttattattacttnnnccagcaattttgcaagangcagaagtntgacattgaattgagtgagacgagcgtgtcaatgagttataatctgtcactgtcattatttaatatgttgcttttaaaatagtatatgaaataataaaactgtaacagtaaatggttattagattgcttacctaa

SEQ ID NO: 6826 - DNA, 2195 bp, Homo sapiens
agtgcgtgagtttggtggcggccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtacactaagaccctttgatgaaagatagcaataatattaataattcaaacatgaataactaaaccaaaattgcacccaccatgagcatctgtaatttgctctttaaccattccttttttaggttttaactaatactttgtttacgtgttattagtttttaattgttttcatactgttttgaaataattttatacttatagaaaagttgcaagagtagtacaaaggattcacatatcctctttactcagattcccttaatgttagtttaccgcatttgcattacctttctgtctacatatgtgtttgtttctgaaccatttggaaataagttgtagacgtgatacccctttacctataaatatttacatgtgtattttctaaaaacaaggacattcagggccgggtgcagtggctcacgcctgtaatcccaacactttggaaggccgaggtgggtggatcacctgaggtcaggagttcaagaccagcctggccaatgtggtgaaatcaaccctctctctactaaaaatgcaaaaattagccaggtgtggtggcgggtgcctataatcccagccacgcgggaggctgaggcaggagaatcgcttgaacccaggaggtggagttgcagtaagccaagatcgtgcccctgcacttcaggctgggcgaaagagtgagactccatgtcaaaaaaaaagtgctttcccttctctcttatttatttattcataccagtatgcactcatggattcttattttagtcaatgagttataatctgtcactgtcattatttaatatgttgcttttaaaatagtatatgaaataataaaactgtaacagtaaatggttattagattgcttacctaa

SEQ ID NO: 6827 - DNA, 1940 bp, Homo sapiens
agtgcgtgagtttggtggcggccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaagaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataattgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 6828 - DNA, 1586 bp, Homo sapiens
agcggaggctcgtaactgtcggttctttccccttcggtcttaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaagaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataattgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 6829 - DNA, 1379 bp, Homo sapiens
  misc_feature (23)..(23): n is a, c, g, or t
aaaataagaacgggtttgcccantttatgccctaaacaatgagtagaggtatattaagaacaaagttgactcaagaaatcaaatttgcttttcttttctttctgttcctgttttgttgtcactttgaaatatttttgttttgttttgaggtaggatttatttgcttactttattatcagagaaaggagcagatttatgtgaaatgttaagtatgctgatcataattttattcttgtgttaaggacttggaataaggacagttgcaaagttaactcaatttgttgatgtattgcctgtgttctttttctgaatgctgaagtaaaatattccagttttaaaagtatgccaattttcagtgggaatatattttatatgtttttgaataataatcaagtattttatttttttcctcctcgcaatgatgtctcaaggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaagaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataattgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 6830 - DNA, 868 bp, Homo sapiens
tctctctcatgtatacatttttctatcatcatgtgtgaagccagtgactatgaaatttttcatgatcatttcttatttccttttagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaagaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataattgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 6831 - DNA, 682 bp, Homo sapiens
gcggtcgtttactactactaaattcgcggccgcgtcgacgttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaagaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataattgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 6832 - DNA, 1634 bp, Homo sapiens
  misc_feature (23)..(23): n is a, c, g, or t
aaaataagaacgggtttgcccantttatgccctaaacaatgagtagaggtatattaagaacaaagttgactcaagaaatcaaatttgcttttcttttctttctgttcctgttttgttgtcactttgaaatatttttgttttgttttgaggtaggatttatttgcttactttattatcagagaaaggagcagatttatgtgaaatgttaagtatgctgatcataattttattcttgtgttaaggacttggaataaggacagttgcaaagttaactcaatttgttgatgtattgcctgtgttctttttctgaatgctgaagtaaaatattccagttttaaaagtatgccaattttcagtgggaatatattttatatgtttttgaataataatcaagtattttatttttttcctcctcgcaatgatgtctcaaggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtacactaagaccctttgatgaaagatagcaataatattaataattcaaacatgaataactaaaccaaaattgcacccaccatgagcatctgtaatttgctctttaaccattccttttttaggttttaactaatactttgtttacgtgttattagtttttaattgttttcatactgttttgaaataattttatacttatagaaaagttgcaagagtagtacaaaggattcacatatcctctttactcagattcccttaatgttagtttaccgcatttgcattacctttctgtctacatatgtgtttgtttctgaaccatttggaaataagttgtagacgtgatacccctttacctataaatatttacatgtgtattttctaaaaacaaggacattcagggccgggtgcagtggctcacgcctgtaatcccaacactttggaaggccgaggtgggtggatcacctgaggtcaggagttcaagaccagcctggccaatgtggtgaaatcaaccctctctctactaaaaatgcaaaaattagccaggtgtggtggcgggtgcctataatcccagccacgcgggaggctgaggcaggagaatcgcttgaacccaggaggtggagttgcagtaagccaagatcgtgcccctgcacttcaggctgggcgaaagagtgagactccatgtcaaaaaaaaagtgctttcccttctctcttatttatttattcataccagtatgcactcatggattcttattttagtcaatgagttataatctgtcactgtcattatttaatatgttgcttttaaaatagtatatgaaataataaaactgtaacagtaaatggttattagattgcttacctaa

SEQ ID NO: 6833 - DNA, 1445 bp, Homo sapiens
agtgcgtgagtttggtggcggccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtacactaagaccctttgatgaaagatagcaataatattaataattcaaacatgaataactaaaccaaaattgcacccaccaatcacatgcctatcatatagtaaaaaaaaaa

SEQ ID NO: 6834 - DNA, 1039 bp, Homo sapiens
agtgcgtgagtttggtggcggccggctgtgcagagacgccatgtaccggctcctgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcatttttgtattcactatacccatgagctgactgacagccat

SEQ ID NO: 6835 - DNA, 580 bp, Homo sapiens
aactatttgccccagacaactgtttttcccccttccttctatggattgaccagccagttctgctttagatggtattggatggagccctggaatggctgaaaagtccaaactggcctgacttgctcagccagcaatgcggtgcaggctcctagctggggccttagttctcctgcacctgcggctctccatatggctgcttggacttcctcatagcatggcagatggattacgagaaggagcattcccaaataaaggaccacataagctagatctctggagggctagcctcagaagtcacccagtgtcacatgggccacattttattggttacagggccagccagtttgaaggggaagagaaatatgtcgctgtttatgctgtgtccagtgctagcttgctacctgctctcccagttccagtgctcagggcagcactggcagaacagatgtacttactgagttaaaaacagcaacatccaagacaattgttaacttttaaaactgtctcccatcccagaaggtataactaaaaaactaacaataaaaataatagtaataaataataaaaataaaaataaatg

SEQ ID NO: 6836 - DNA, 597 bp, Homo sapiens
aactatttgccccagacaactgtttttcccccttccttctatggattgaccagccagttctgctttagatggtattggatggagccctggaatggctgaaaagtccaaactggcctgacttgctcagccagcaatgcggtgcaggctcctagctggggccttagttctcctgcacctgcggctctccatatggctgcttggacttcctcatagcatggcagatggattacgagaaggagcattcccaaataaaggaccacataagctagatctctggagggctagcctcagaagtcacccagtgtcacatgggccacattttattggttacagggccagccagtttgaaggggaagagaaatatgtcgctgtttatgctgtgtccagtgctagcttgctacctgctctcccagttccagtgctcagggcagcactggcagaacagatgtacttactgagttaaaaacagcaacatccaagacaattgttaacttttaaaactgtctcccatcccagaaggcagagcttgcagtgagccgagatcgcgccactgcactccagcctgggcgacagagcaagactccgtctcaaaacaaa

SEQ ID NO: 6837 - DNA, 423 bp, Homo sapiens
ttgtgaactgtggagggcagttgtcagatgtagagggtgaagaacactcctattgcagggcaggaatttccagcaaatggcaagcctttgattaccatcatgggagggggctgaggattacagctggaaccaaatgctgatgctactgaggcaaataactttgaaaatgtagtatttgcctttattttgctctgctttgcatataggaagtgttatggactgaatgtttgtgtcccctcaaaatgcatatgttgaaatcctaacacccagtttgatagtattataaggtggacctttgagaggtgattaggttgtaagagtggagcactcatgatgggatcagtgcttttataagaagaaacaacttgaccaaaaatttgtcacagaattttgagacccattaaaaaagttaaatgagaaaaa

SEQ ID NO: 6838 - DNA, 450 bp, Homo sapiens
atcagccttcagaagagcatttaaacactgccacacgctgtccgtctgtttgtcctgcaaccaggttctccccttggtctcagtggaagcctgaatcacaagcactgccacgttcacaaagctgttaattcttcaaaacgccaaatggtattcaaaaagggaagtataggctgggcacggtggctcacacctgtaatcccagcactttgggaggccgaggcaggctgatcatgaggccaagagatcctggtgaaactatcctagccaacatggtgaaaccctgtctagtaaaaatgcaaaaattagctgggcgtggtagtgtgcacttgtaatcccagctactcgggaggctgaggcaggagaatcacttgaacctgggaggcggaggttgcggcgagctgagattgcggcactgcactccagcctggtgacagagtgagactccgtttc

SEQ ID NO: 6839 - DNA, 1646 bp, Homo sapiens
actgcgcatgcgtcaggcatggagagcggaagcggaaggttgaatgcgtcgggtgggcacctcagcaaccagtagccatgcgcggcttggaggagccggggcctcggcctacagcgaccccgtgcggctgcgtgaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatcaccaaatgctttttgatctgttgatattaaagaatcaaaaggtg

SEQ ID NO: 6840 - DNA, 1593 bp, Homo sapiens
actgcgcatgcgtcaggcatggagagcggaagcggaaggttgaatgcgtcgggtgggcacctcagcaaccagtagccatgcgcggcttggaggagccggggcctcggcctacagcgaccccgtgcggctgcgtgaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatac

SEQ ID NO: 6841 - DNA, 3015 bp, Homo sapiens
  misc_feature (1417)..(1417): n is a, c, g, or t
  misc_feature (1468)..(1468): n is a, c, g, or t
attttatcaatttgtaatggctaacaaacttggatagcaagtactagaagattttatgattattcagggacatattttctagcactgaatatgtgccagacattgtcctaggtgctagagctatagtgataaacaaatcagatgaaagtagaaatccatgccctaaagaacttaatgtttcaattgggaaggtcaagtcagataggttaaaaggcaaacacagtagcactgtagacattactatataagctttatggcaactagtgtttgtgcagtgctttacagttagtaaacagtgttcacgtaccttatctcacagtggctttgtgggtttgacaaagtagcaatcctcatctcataggtgaggaaactagggctctttaagattagataatctgtctaatagcatccagccaggtggtcatctgactctaaatcctttgaagtcttacttatgctacagtgcctttctttttcctacagatattgttaggcataattcatcatctagcaagtccagaatcatctttccagagttccagctcattcataataacatgtttcagaaatcagggtcctgtattagttacgtttttcttaaatggagacggaatcaaatgtgactgcatgtagtttttctgttctcatttggcctattttccaagagtaaggttagtagatggctatttgtagcagtaactggacagcatctgtccagtgggacagctggagacttgtctttagtatttggtaatgctgacttatgtgctgcttaatcttttgagtcttgatggatgtattagatttctattgttgtgtaacaaattaccacagaatcatcagtttaaacaacacacatgtattatgtgtttgaaacattattatgtatctgtgggtcagaaggatgggcacagcttaactaggtcatctgcttaggtctcactagactgcaattaaattgtcagctgatatgagttcttatctggaggcttgaccatggaagaatctgcttaagctcactcagactgttggccacattgatttccttgccatcgtagtaggactgggggccccagattcttgctggttgttggctggaggctgccctcagtgtctaaaggctgtttgcagttccttgctatgtgggcttcctagcacgcctgcctacttcagcaagccttcaaggagagtctctcgagtgagtcttccagccagcagcagtgctaatgaaaagcatagtcactggagggacatcatacctcttttgccatattctgttggttagaagccagtcacactcaaggggaaggattatataagggcatgaacttcaggaggtgcgggtcacagggccacttttggatctgtttgccacagtaagaaccttcattggtcccacagagatatactgaggacnactatatccctggaacagaagcaccagtgatacaaagatgagttggtcccngcctgtgttaaggggcctgcctgcgtctagggatgaagactctaagcaggtcactaccctaccgtggggaaagcgctctagcagaggtttgtgcacaggcttctctatggggactgtaggaaagaatgcttttgtctggaggagccagaaaggctttgtaaaaggtgtgcttttgagggcctcaaagagcaagtaggagtttgataggtagagaagaggatgggctaccaggtagcaagaagggtgtgtgttggtactaggtctgtgtgagagaattatgagtaagtgcagtgaggcgtaagcagacagtgttagaggattctggggcgtgactgtattctccaagtgtttgcactgttcttcatttttcacgtttttatgtcataggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatcaccaaatgctttttgatctgttgatattaaagaatcaaaaggtg

SEQ ID NO: 6842 - DNA, 3204 bp, Homo sapiens
  misc_feature (1417)..(1417): n is a, c, g, or t
  misc_feature (1468)..(1468): n is a, c, g, or t
attttatcaatttgtaatggctaacaaacttggatagcaagtactagaagattttatgattattcagggacatattttctagcactgaatatgtgccagacattgtcctaggtgctagagctatagtgataaacaaatcagatgaaagtagaaatccatgccctaaagaacttaatgtttcaattgggaaggtcaagtcagataggttaaaaggcaaacacagtagcactgtagacattactatataagctttatggcaactagtgtttgtgcagtgctttacagttagtaaacagtgttcacgtaccttatctcacagtggctttgtgggtttgacaaagtagcaatcctcatctcataggtgaggaaactagggctctttaagattagataatctgtctaatagcatccagccaggtggtcatctgactctaaatcctttgaagtcttacttatgctacagtgcctttctttttcctacagatattgttaggcataattcatcatctagcaagtccagaatcatctttccagagttccagctcattcataataacatgtttcagaaatcagggtcctgtattagttacgtttttcttaaatggagacggaatcaaatgtgactgcatgtagtttttctgttctcatttggcctattttccaagagtaaggttagtagatggctatttgtagcagtaactggacagcatctgtccagtgggacagctggagacttgtctttagtatttggtaatgctgacttatgtgctgcttaatcttttgagtcttgatggatgtattagatttctattgttgtgtaacaaattaccacagaatcatcagtttaaacaacacacatgtattatgtgtttgaaacattattatgtatctgtgggtcagaaggatgggcacagcttaactaggtcatctgcttaggtctcactagactgcaattaaattgtcagctgatatgagttcttatctggaggcttgaccatggaagaatctgcttaagctcactcagactgttggccacattgatttccttgccatcgtagtaggactgggggccccagattcttgctggttgttggctggaggctgccctcagtgtctaaaggctgtttgcagttccttgctatgtgggcttcctagcacgcctgcctacttcagcaagccttcaaggagagtctctcgagtgagtcttccagccagcagcagtgctaatgaaaagcatagtcactggagggacatcatacctcttttgccatattctgttggttagaagccagtcacactcaaggggaaggattatataagggcatgaacttcaggaggtgcgggtcacagggccacttttggatctgtttgccacagtaagaaccttcattggtcccacagagatatactgaggacnactatatccctggaacagaagcaccagtgatacaaagatgagttggtcccngcctgtgttaaggggcctgcctgcgtctagggatgaagactctaagcaggtcactaccctaccgtggggaaagcgctctagcagaggtttgtgcacaggcttctctatggggactgtaggaaagaatgcttttgtctggaggagccagaaaggctttgtaaaaggtgtgcttttgagggcctcaaagagcaagtaggagtttgataggtagagaagaggatgggctaccaggtagcaagaagggtgtgtgttggtactaggtctgtgtgagagaattatgagtaagtgcagtgaggcgtaagcagacagtgttagaggattctggggcgtgactgtattctccaagtgtttgcactgttcttcatttttcacgtttttatgtcataggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatacagagaaatcaccaaatgctttttgatctgttgatattaaagaatcaaaaggtgatgctgtctcgataatttctgaaagaagctgttcttggtgcacttgataaaattagacaaagttcattccagcagagactttctagttgaggggatctattcagtaattcatattggttttcctgtctgtctggaaaagcctgacctttctatttgattccaaatcaaacctatatcaggaaactaaca

SEQ ID NO: 6843 - DNA, 1361 bp, Homo sapiens
actgcgcatgcgtcaggcatggagagcggaagcggaaggttgaatgcgtcgggtgggcacctcagcaaccagtagccatgcgcggcttggaggagccggggcctcggcctacagcgaccccgtgcggctgcgtgaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaaggtatcttcagtttcttcattctgaatgagagatgaacttttactttgagatttagccaagtttggtatttgtgaaggcaggtatgtggagtgtttgtcagtatgactggtttttaggaaacaggtatgaaataatatttttgcagtaccatcatgtgatgacttttgttggacaactgtgtggtcagcacagttagttccaggctgtcagtaaagcat

SEQ ID NO: 6844 - DNA, 1696 bp, Homo sapiens
actgcgcatgcgtcaggcatggagagcggaagcggaaggttgaatgcgtcgggtgggcacctcagcaaccagtagccatgcgcggcttggaggagccggggcctcggcctacagcgaccccgtgcggctgcgtgaagccggctctggagacagggaatcttttaactgagccagtcggctacttggaatcttgtttctcggccaagaatggtactccaagacagccatccatttgtagctattctcgagcctgtttgaggattagaaagaggatctttaataatcctgaacattccttgatgggcctagaacagttttctcatgtttggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaagccttggggaaatggacagatatcatggctgcagtgctgatgtcaactgtgctgtgtggcaggagtctgggatgaatcacactacaaggacaaacattggtcaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatac

SEQ ID NO: 6845 - DNA, 1418 bp, Homo sapiens
actgcgcatgcgtcaggcatggagagcggaagcggaaggttgaatgcgtcgggtgggcacctcagcaaccagtagccatgcgcggcttggaggagccggggcctcggcctacagcgaccccgtgcggctgcgtgaagccggctctggagacaggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatac

SEQ ID NO: 6846 - DNA, 1521 bp, Homo sapiens
actgcgcatgcgtcaggcatggagagcggaagcggaaggttgaatgcgtcgggtgggcacctcagcaaccagtagccatgcgcggcttggaggagccggggcctcggcctacagcgaccccgtgcggctgcgtgaagccggctctggagacaggattttgtttgtttttcacaaaaatggtcatttgagctgtaaggcaaaagtgcagcctcctaggctgaatggtgcaaagactggagttttttccacaaggagccctcatcgtcccaatgcaataggactgaccctggccaagctggaaaaggtagaagccttggggaaatggacagatatcatggctgcagtgctgatgtcaactgtgctgtgtggcaggagtctgggatgaatcacactacaaggacaaacattggtcaggtggagctatatacctttctggaattgacatgatacatggcacacccgtactagacatcaagccctacatagctgagtatgactcaccgcaaaatgtgatggagcctttagcagactttaatttacagaataaccaacatacaccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatac

SEQ ID NO: 6847 - DNA, 991 bp, Homo sapiens
  misc_feature (6)..(6): n is a, c, g, or t
gaatcnagccgttaccttccagcaacgccaaacactgtgtcccagtctgacagcaagactgacagctgtgaccagcgacagctctcagggtgtgatgagccacaaccccaccatagcactaagaggaaacctaaatgtcctgaagacagaacttcagaagaaaactacctgacacacagtgacacagccagaattcagcaagcatttcctatgcacagggagatagcagtggattttggtttggaatcaagacgtgatcagagttccagcgtggcagaagaacaaattggcccatattgcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatac

SEQ ID NO: 6848 - DNA, 669 bp, Homo sapiens
tgtaccctttctctgaaaagctcttctctgggctagtatgggccaatatgttcttctgccacgctggaaactctgatcacgtcttgattccaaaccaaaatccactgctatctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctagggtcttaaggagcctccctcatgtctttaaggtagcatcattgatctttggatgtggcttttggattttctgaacaagctaatgttgtgtcgagaagcaacactttgtgatctcatggctttgattgatttgggctgttcaaaatgtttatttgaaaaacgtatacattaataaacttaacaaagagatataaaatac

SEQ ID NO: 6849 - DNA, 473 bp, Homo sapiens
tatgattcctcaaaaataagaggaaaattttaacaattatgccctaagatggacccatgacaatttaggagtcattgggatcaccccccaaagccaaatgttaatttccttgggatttccttctgtacatgcaaagaacttcaggccatcctatgatccctcacaaataagaggaagattttaacaattatgctctaagatggaacatgacaatttaggagtcactgggatcaccccccccacctttccaacgttactctgctttaactacaaatatgtcgaatggttttctaatttttctttaacttaacctctaaagttcgagagctgtcatctttgtcaagtctgattgttgagtatgtgaatggatgtttttggctcaatgttagagccaaaatttataaataataattatttatacataatgatattgcaaataaactttaagaaagagctttaaacataaaaaaaat

SEQ ID NO: 6850 - DNA, 393 bp, Homo sapiens
tgcggtccatttgcagcctgagtggagaggatggggcagggatcccaggtgaggtcgagtaaggaagtcgcagttctgacctgggaatctgccgggacaagcctgctctgtctcagcatcaaggcgtttggtacctagaggagcagggtgccagggtgtccagaccgggcaaaccaggagccctagatcccgtccctggaactaggtcctccgccagctttgcgggcctcctccgcaccaggctcaggtctcgcccatccccagcaggaggtctctctgccccccaccctccggaggggggttatatgatcttaaagcttccccagagggaggaaaggtgggggcggggcggctgctgaggcccaggatataagggctggaggtgctgctttc

SEQ ID NO: 6851 - DNA, 399 bp, Homo sapiens
gattctcgcattcttgctcttaatcctcccttggcgaccttctactcagacatcatcttttatgcagagaagcaggcacgtttctcatcattaattctgttctcagccaggtgtgtagccacagagcatacagaccacaggatgattgaaagcatattgactttcctgacttcttatgaccacatttgaggaaaggagtaagcactggaatcaccaacacagcatgcttacggagggtggtcaccagcttcatcagcctcccaattccacggagccccttgaaaatccaggagcgcagactggcaacagtagagatttaataggagtttactggaggttatactccagtcaaagaagatggaaaccaagaaaggacacattttggagattagcactggc

SEQ ID NO: 6852 - DNA, 704 bp, Homo sapiens
ttgagacaaggtctccctctgttgccccgactagactgcagtggcatgatcactgcagcggcatgatcactgcagccttgacctcccaggctcaagcaatcctcccacctcagcttcccaagtagttgggactacaggtgtgtgccatcatgcccaactaatttgtaaattttttttatagagataagtctccctatgttgcccaggctaaacttgaactcttgaactactgggctcaagtgatcctcccacctcagtctcttgaagtgctgaaattataggtatgagccaccatgctcagctatttatataatttcagattaattttgtcccagccattcctctagaaaacaaaatatggtcagctctccatacccatggattctgcatccacggattccaccaaccatggaatgaaaatattataaataaataaataacaatatgaataaaaaaatacaaattttaagatacagcaaaaaattatttacataacattcacactgtattattaggtattataagtaatctaaggtgatttcaagtatacaagagaaatactgtaccgttttatataatggacttgagcatctgtagattttggtatccaattccccatagatactgaggaactgtacacagaatctgcattttagctttaaggtctataaaatccctctagcatccatcacttctgaggatac

SEQ ID NO: 6853 - DNA, 628 bp, Homo sapiens
cccatgctcccactgtatttgttgagtgggcgaaccttagtggagagtactgtacggaagacaggtcggtagctttatgcagccagttatttgaactaaagaattatgaatccttccttttcctcccactttgttcccctttcctcaccctcgtgacctccgatcttagggcagttgttagcagcaggaagtggcccagatcataaaccactccttccttgcaagctactttggcagttcattagtgacctgaaaactcaaagcgtaaatgcttcagagccgaggtaattttttataaaataagtaattcttataaggataaaaatttctcctaatttatctgatttgtaaatttggatatacattttaaatgtttgaaggcacttatttataactgttgggagatctagccctaatttggatttatcttctatttcgttaggatgttatagaatgataatagatgcaaatgagatagttgttgaatgcagcaactatctacgatctatgatctctgatctgggctaggtccagagagaggggtgggtaaacggtttacatctgggccatagagtttggaaggcctagtgataagatatttaagtaacttggcaatgaaaggaacatc

SEQ ID NO: 6854 - DNA, 725 bp, Homo sapiens
gagttcgagaccctgtttctacaataacatataaaaattaggtgtagtggcatgtagttctagctgctcaggagggtgaggtgagaagattgcttcaccagggagttcaaggctggattaagctaggatcgcaccactgcactcgggcctaggctacagagcgagactgtgggggggggggcagtatgaggaagtgtgtcaacactgggaagatctgtgtaactcattgaaccaatattttcccaaatgaccaattcatgttacaaaatcgtgcatgggtaggcgatccgttcaaagtacaacatagacaaatggatttttatatacaccagagccaaaaagttcactgatacagtgaattccacattgcaactaacctttcagaattgccacttgagttttggtgttgaataaaagatgaatatccattgttttctgagaaggctgttaaaatactcctctcttccaattagctgtccatgtgagacacgttttcttcatgtactttaaacaaaacaacatatcatagcagattgaatgcagaagcagatatgggaatccagctgtctcctattaagctaggcattaagagaaatttgtgaagatgtaaaacagtgttactctgattcctgactttgttttagaaaattctgtttttcataagatgtttatattaacgtaatgggtttattattttaaatgaattaataaagcaaataccaaaa

SEQ ID NO: 6855 - DNA, 748 bp, Homo sapiens
cagagcgagaccgtctcaaaaaaaaaaaaaaaataccatctcccaccggtcagaatagctattatcaaaaatacaacacatgctatcaaggctgcagataaaaaaaacccataccccgttggtgagaatgtaaattagttcagccactgtggaaagcagtttggagatttctcaaagaacttaaaacagagttaccatttgacccagcaattccataactgggtatatcccaaaatgaaaataaattattataccaataagacacatgcactcatatactcatcactgcagtactcacagtagcagagaagtggaatcaatctaggtgcccgacaatgctggattgtattaagaaaacgtacatttacaccatggaataatatgaagctataaaaaaataaaatcatgttctcagcagcaacatagatgaagctggaagccataatctaaagcagattaactctggaacagaaaaccaaataccacgtgttctcacttagaagtggaagataaacaaataggcactgtggattcctaggagagtaggaagagagacgggcatgtgttgaaagactacctgtgggtgccatgcttactatacccaaaatacccatgtaacagtcctacacatgtatcccccgatttaataaaagctgaaatattaaaaatcacattgtacaccacaagtatatataattgtaatttgtcaattataccttaataaatctgaataaagaataaagtgtaa

SEQ ID NO: 6856 - DNA, 582 bp, Homo sapiens
atgcattttttcagcaatgtttagtcaaagggctgcatgtgagtggtcttttgagtcatcagtagatgtagtataatgtcacttctgtgtcttcgcttacttttattgccctattgcatagcaagactttatttatcagttttagacaacgattatggtgggaacttgagggcaggatagagcttttctactagttaggacatatatgtagttttcaaacatgaggatgttgctactaatgcatctcctagaatatgaagaagaaaaccacataataaagaatgcaggccaggcgtggtggctcacgcctgtgatcccagcactttgagaggctgaggtgggtggatcctgaggtcaggagttcgagaccagcctggtgaaaccctgactctactaaaaacacaaaaattagccagcaatggtggtgcgcacctgtagtcccagctactcgggaggctgaggcaggagaatttcttgaacccaggaggtggaggttgcagtgagccgagattgcgccactgcactccagcctgggcaacagaacaagactccatcttaaaaaaaaaaaaaaaaaaaaaaaaa

SEQ ID NO: 6857 - DNA, 347 bp, Homo sapiens
aagactctgtctaacaacaacaacaactatagctatagatatagatatataggattaactgcatatcctatcatgcatttcaattattatatattaaatgttctctctttagtatttcacttcacatctctgctggattgaggatctcagggagtgttttacagctaacgtgtgccagacttccccatctcagtcccattctaggccaactcatgatgcatgccctgtccgggttccaatagaggtttggcggaagaatccttacaaacaccaaatccttgatctgtcctgaggaagcctgaatcatctgattggccccagaatcaccctgattttccatgaattcc

SEQ ID NO: 6858 - DNA, 462 bp, Homo sapiens
gaaatggtgaaatatcatttcattaatttttaccaatttttctaattgaatcccgtggttttcttatagtgagttttgaaaattctttatatattctaaatactagtcctttattggaagtgtagtttacaaataatttctcccagtctgtagcttgccttttcatcctctttcatgtcatgtttcagagagcaaaggttttttattttaatgagttccaatttcctgttacgggttgtgttcatgtcaagtctaagaattcttgcctagtcctagatcctgaagatttcacctatgctttttgcttttttacagcaccatatgttgaaaaggctatcttccctccattggcttgtttttgcatctttgtccaaaatcaagccaggcactgtagtgcttgcccgtggtcctagctaatcggaaggctggggcaggtagatcacttgagcccaggagtttgag

SEQ ID NO: 6859 - DNA, 449 bp, Homo sapiens
ttgtgtctacagcatttttactgactgcttggcattcttttgctcctcatccatggcctctattcatacctagaatggatggctgttcagaatgaagctggcatcactgtgttcaccattcaggaagagggatatttttctttgctatctctcagctccttatgagactcctcaatgtagcctgcacggagtgggtgtttatctccttccaaaaagtgcacacttgtctcacccaatttggaactggagtttgcgatttggctagaactctacaaagattgcactccagctgatgataagtttgcacgttctagtctctctctccaccacctctcactgggtcacctagaatccctctgggtgaggcacaagaaaacaacattttcattgctttaagtcagaggcagttgtttagaactggtttgtttttccataaagtcattgtcctt

SEQ ID NO: 6860 - DNA, 426 bp, Homo sapiens
ccaatttaccatgtggcagtgtgctttccagctgttttcccatcaagacacacatgggaaataacatttgcctagtacactggggtaaactgacaaggtgctcacggccacaggtgaccatccagggcctccaatcatcccaggctcagccctgccactcaaagggctaaggtgatcagtagctttagctatttgtggcacacagatagagaagttcttccatacagcatatgctaaggaaaaaaacaatagtggtagaattctttggtgtaggttctcatttgtgcagcattgtttctcaaaaagacatttaaagcattcaattgacttgcaatataaatggcttttgaactatatatataatatacaaatatatatatattataggagttaactacatatatatatgtatcataacacacaaat

SEQ ID NO: 6861 - DNA, 300 bp, Homo sapiens
tttatttggcaaccttggctctactctaaaacctatcatttctggattattgccacagattaatctcttagtgtaaaggttaaatcctctcctttctctgagctctcatgctcacattcacacacaggctcaggaggcccgacttcctgacttccagggctgcggggttgcaatgtgtgagattctctagctaggcagatcctatgcatttgacagaggagactgcagccagagcaacccctccaacatggaggcccaaaggaatgggggatgagaggagtgttctggcattcacacagt

SEQ ID NO: 6862 - DNA, 782 bp, Homo sapiens
ttcagcagctccacctcctccagggtctggctgtgctcctgtccctcggccccaggatgcagaatctgtaatgactggtgcttacctgccccccaacccccaccccagggagggcaggggccttgcctcactccactccgtgcccagcatggtgcctagcactacctgagtgttcagaaagtgtctgagagaacacagaggagttggaagcaaactccagccagcaccaggaggcatctttacattaaacagcaacagtcagcggaaccagagccagcatgtgccagcctctcttttcccctcagtggtgtcaccaggagccgacagagagaaatgaggctcttccggttaggggcttcaaggacgctttctgtacagtgtgtctgcaaagttaagggacatgtgtgcacgtctggatgtgctcacttctcgagggcctcctccctggggatctggggaaaggtagagctcagttctgaagcctctctagcatcaagggctacctcctgagaccaaagggaaattctacaaagttcacagaaaataaggggtttcagcatatcacagaaaaactgaaattcagtaatgtgacaatgaacccaagaggaacaggttctgacagagtttaaaaggggtccttgcttctcctgggatgctcagaatgggaactctgccacaggtttatcaaaaacccaggattgctatttttatttccctcttctattagttcgtctcaaaagaaatatcagctccttaaagggacagacaatgtttttcaactt

SEQ ID NO: 6863 - DNA, 357 bp, Homo sapiens
ttaattaatctttctctgatcgctaatgacagttggttctgttatcagccaccaatcatgttaaatacagtatgtagaatggttcaaatctaggaagcatttcgtttgcaaagaaacctgtatatttacagactttaaaagatggatttttttttttttagagagagacttgataatttttaaaacaaagcttttgaaaagtgggcagttcttggggtggggggagggaaagcactaggagatacacctaatgtaaatgacaagttaatgggtgcagcacactaacatgacacatgtatacatatgtaacaaacctgcatgttgtgcacatgtaccctagaacttaaagtataataa

SEQ ID NO: 6864 - DNA, 339 bp, Homo sapiens
ctgcaggtgttcactaaacttggaaaaatgccaccgcctttctggcacaatgtaccatcttggaacaccagcattctgccctgaagccagccctggcctcagaggcctgggccacagggagaacctcacagcccaggacactgtggcactctgctgtctagaagcctgtctccccacccttcccattctaaccccatgcgttcctcagcctccccactgtgcaagcctaggtaaggacattatgaagacgtcagcctgcctctcacattcccctgcacactgctgtccctctcccgcgggccaagcagacccactgtggcaaaaatatagaagaatgac

SEQ ID NO: 6865 - DNA, 414 bp, Homo sapiens
caatgatcaagggggatttatccctggcattcaggtttggttcaacaaatgcaaatcaataaaagtgattcaccatattaacagaatgaaggataaaaaccatatgacaatctcaatagatgcagaaaaagcatctggtcaggcatggtggctcatacctgtaatcccaaaacattggaagaccaaggtgggaggagcacttgagcccaggtgttctagaccagcctaagcaacgtggtgagaccctgtctgtacaaaaaataaaaaagttagcagggcatagtggcacatgcttgtagtcccgtttgagaggctgtggtgggaggactgcttgagcctgggaggtcaaggctataatgagctgtgatcatgccaatgcactccaacctggttgacagagtgagaccctgtctc

SEQ ID NO: 6866 - DNA, 387 bp, Homo sapiens
acaaaactcaaaagagttaatattcagtgtctagttcctctcctcctattctttccttcaatccaattgttctagttaaggtcgtgagcttcatttccaactccaggttgttaaacgcaggagtcagttatcagcctacctttgataactttgcatttgatgctgacactccctcctccttggaacaattcctttggtttccaggggaccacacttctggtttctgcttaccggcaggaactccttttccatgctctcttgttggttctttttcatcttcacaactgaaaatgtgagtgccccagggctcaggggcagtcctttgatcccctccttttcttgtctacctcactcctgagcagcccatcacctcatgcctttaaatgt

SEQ ID NO: 6867 - DNA, 290 bp, Homo sapiens
acgctatgatatatgtataaattcttgtagagacatttaaaaagtctattaactttaatttctgcccccaccttggtcttcttatccttcatcatttctattttatattgtacttatcctcactttcttaacacttaagatacatggatcctttctggtaatcccaatcagagaagccaggtagactttcttagaccatttatattttattcccaaatacttcattattctaactcaagcctcatgtttcagagatgcagatataacttgtcacttaaatgttgaaagaa

SEQ ID NO: 6868 - DNA, 270 bp, Homo sapiens
atatatctccatgatgcaattaagctagaaaacaataacaaaatgataatacaaagtccccgtatgtttggatatttaggaaaatagaagttctggatgacccatatagcaaagaaaaataattataaacttaaaaaatgaaattgctatatataccaaaacttgtgaaatacaactaaagtcacacttagacatttatagcattaggtacctacatttgagaagaaggtttaaaaattcatgaactaagcattcaaggcaaacatcaaa

SEQ ID NO: 6869 - DNA, 453 bp, Homo sapiens
ctgactccctagttccctggcacaaaagagatcttgagtaattccctgaacctccctagataggaagaggcacttagcccatgttctgctcaccacaaatacttgtgtatggtaggcattggttgttcccttcctaagatccactttacatccattctttcctaacagaaatctgattttgtttggagcagcaatgctcagctcatatccagcttcccacactctcttacagttaggaaagactgtatgacccatttgtggctgggcagatgtatgtggaagtcactggatggaactttctggaaagcttttagaaagagactgacttggctggcatcctctttcccctttgcctttccccctcttcttgcctagggagaatgtgtcaaacttggagatccagcagccgtctatgacaatgaaagtgaaagcctcactgaaggacagcagagg

SEQ ID NO: 6870 - DNA, 312 bp, Homo sapiens
gttgcctcagctggtcttgaactcccagtcttggcctcaagtgatccttctgcctcagccttctgagtagctggaagcacagctgtgagccagcacacctggctttttttaatttctaataaaaaagttaatagagtttcttgtttcactggacaaagtatgcatatataggaaggaaagacttttggacttgagattgtgctgaagaagaaaaatggaaaaattaagcattttagtctctcagtgtgttatttttgtagcttatacagatatgtctttttaaagtgtctttaaaaagctttattgagataa

SEQ ID NO: 6871 - DNA, 367 bp, Homo sapiens
ttttgatagagtgtcatccagtctggagtgcagtggccaatctcagctcactacaacctctgcctcctgggttcaaaccattgtcctgcctcaacctcccaagtagctggaattataggcatgagcactatacctggctaatttttgtatttttagtagagacaggtttcaccatgtccaggctagtctcgaactactgacctcaagtgatccacccacctcggcctcccaaagtgctgagtaaaattacatgaaacgtaatttgtgagatactaaaacatctacttaaagtaagatgctttataaaaagttggaggataaggagttaaatgaacagagtatatatttttaataattagattctaca

SEQ ID NO: 6872 - DNA, 470 bp, Homo sapiens
  misc_feature (438)..(439): n is a, c, g, or t
  misc_feature (468)..(468): n is a, c, g, or t
tgggtgaggggaggccggaagcttgggaaaggtgtgtgccccccccccccgcaccgcgccgcccgggtgctgggtgggccaggcgacgggaatcctggagcgtgccggggccgcgcgccttcgcctgtttcccgtgcagaccgcccagcgatcggcggcgcagagcccggcaggggcggccctcccgtcgtgcggtttagaaatcgcacacgttcccggtctgtgagtccccggcgccggggtggtgccagtgctgccgtgggctttcgccgggggctcgggccggcgctcggtgacaaagagtcggcttgggggaggggaggcgacgccgcagtgctcgctccccacgtccccccaccccgcacgtgaagaggaacaatttgtttatcttgggcttcaagaatccttccctcctcccagttctccgggggcgctcanntttttttttttttttttccaggttggggnga

SEQ ID NO: 6873 - DNA, 217 bp, Homo sapiens
aaaaaaaaaaaaaaaaacaggatctaaatgggcttttaatttttttttttaagagaaaactagaattgttgaccacattaccaaggaagaataagaatagagaattttattgttaagccacaccaaatttctgccttgttaagagaatggcattactgaaaaactgaagacttcatcaagaaaatgtacataagctaacaatataagattaatcact

SEQ ID NO: 6874 - DNA, 350 bp, Homo sapiens
gggagaggagagggaagcaaactctgactcttgttgtggaatggtagagttctagaagatcacctgggaccaaaaataccactgtggccatttttagaaaatacagtttaccagaggctgaaaacacagctactggaggctgcttctcttgggatttcactctgtctttcagtgctagttctaaactagttgagacagttggcttaacaactttgtggtgaataatggaacaaggccactttcctgtcttcttagacttgtaataggtatatcagtttataagtcaagacaatattctacctttgggctattctcacatcatcaaattaagagcagattttggttaagtt

SEQ ID NO: 6875 - DNA, 420 bp, Homo sapiens
tgtgttctgtccaggaacttgtatcctatcctgcctgcatttcctctgactgcaggcactgccgtggcaccatagagaggatacagaaggcctctctcattatttgtgtgtttaagtgggagggcacttccagtgacagatctttaagaaagagagggctcactcaaccacagcaaaggccagacctctctttgggcaacatgaaattcttgactacacgataatgttgattttgaaaaattatgattgaatttactagaaatggcctgtgttttaactgtgtttttataaatgaggttcaggccggttgcagtggctcatgcctttaatcccagtgctttgcaaggcctaggcaggaggattgcttgaggccaggagttcaagaccagcttgggtaacatggtgagacccctatttcta

SEQ ID NO: 6876 - DNA, 584 bp, Homo sapiens
atgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaag

SEQ ID NO: 6877 - DNA, 505 bp, Homo sapiens
tgagacagagtcttgctctgtcacccagggtggagtgcagtggcacgatcttggcttactgcaacctgtacctcccaggttcaagcgacagaatctcaattttataatcatgactcaacctcacattttgggggaacgttaaatcttctactgtttgagtattttaattgaaatatatttaaaacattatggaaatgtaaacaagatcagagagtatcttctattttttgccgtctctgtgtatgttattggacatgatatgagaagctttatctcaacgttcctgtgcctaacaaccactgtggtaaactagttaaaatgtaaattcctgggccttatcctctgagatttaactcacaaatctgatttttaataagccctataaatcattttgatcttttgagcaataccgttaaagtgaaacagaaacactgaatcttccgtctgtacgtttctgttgcaaaattcagatgtctttctctttgtcgatgtctataaatttgca

SEQ ID NO: 6878 - DNA, 330 bp, Homo sapiens
ccactgtagttctaatggacataattacagttagcaaattcaggctcttctgccatagtgccatttcaaaaccataactcagaatatgcttgtaagaatttaggatgcatattaaagctttgaaaaaaatagcattttcatacaatgtggttttattaatgttagtctgaagagtagctgaaactaatggatctaacttgatttgttgtcgtttcaataaatcttcagtcctctaagcaatacacaaaataagaaactctttaagattagatgtttactgtaatcttctctgtaataaatatatataataaaatatataataaaattttt

SEQ ID NO: 6879 - DNA, 486 bp, Homo sapiens
gaaacattaatcaaaaagtgagtagtagtagctaacttaatgtaccctttgcttaggtttttaaacatgttactattaagactacgtattgtaaaccttctgtaattttcacatatgaatgacaggagaaagttaaacctaatcgaaggagttttggaataaaaaagtggtgctggggaaattcaccatggttcacaaagtatgcctttgtaaaactgaatcaacttttagcaagaattaatttatgtagttttaaatgttaaattgtgtatatttaacagaaaatacttatctggcacctcagcagttttaatgttaccttatacttttaacagtatgatttatattgaatacttagatgttttcataagattttatcaaatttgataatgcggtggttttatgctctggaaaatgtcatcactttaccatagaatcgcgggcccgtgtttttacctctggtttcagcctaatgcatgattacgg

SEQ ID NO: 6880 - DNA, 749 bp, Homo sapiens
gaaacattaatcaaaaagtgagtagtagtagctaacttaatgtaccctttgcttaggtttttaaacatgttactattaagactacgtattgtaaaccttctgtaattttcacatatgaatgacaggagaaagttaaacctaatcgaaggagttttggaataaaaaagtggtgctggggaaattcaccatggttcacaaagtatgcctttgtaaaactgaatcaacttttagcaagaattaatttatgtagttttaaatgttaaattgtgtatatttaacagaaaatacttatctggcacctcagcagttttaatgttaccttatacttttaacagtatgatttatattgaatacttagatgttttcataagattttatcaaatttgataatgtaatgataaaatgtttttttaaatgtgaactatttaacatataaatggggacacaaaacctgaattgtgatttctacataatgtgataattagggttcaaattatgactcatcatttaattgattataaatgagtatatttctgaactctttattgcctccatttttacaatcataatatagcaataatttctatttttatttcataggactgtggtgaagttatttatcatgacacctttatctttgatttctgaggggaaaggggtgtatattttgtagttaagataaatgagaaagttcctaatagtacaaatgcccttttccagggttatctttgctatttgttgccattttt

SEQ ID NO: 6881 - DNA, 446 bp, Homo sapiens
gtgagggagacatcagcctcgtgttttgtgtctgtaatatcaccgccgtttactgagtgcctcctacgagccaggcactgggccgtgtgctttacacgaaatgttctatgtaacacttgcagcagatctgggtagcccatagcctaccaaagggcaaatcgagcttcagagaaagtgagtcttgcctgaaagccagcacctggcagaggtgggctgaggtttggatctggttctgaagcacgttgttcttccccgtggctgtggctttgttcacattagaccacctgacaagtctgcccacctttcccgtctttactggataaaggtcagatcctaagtgtattggaaagttcaaggcaacaggatctgaccacattgattttctaaatgacttccaataagactaacattgaagagtatcaggagcttttccttcctttccaaaa

SEQ ID NO: 6882 - DNA, 1758 bp, Homo sapiens
ttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttcacagagattataactacaatgtgaagtgaatggtgccactgacagttatgcaaaccgtccagagcatagccacctgatcctgctgggattcctctttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacatggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaaacacaataacttcccctaccttacacctacaaccttcatatagaaccaaaaaagagcccaaatagccaaagtaatcctgagcaaaaagaccaaagctggcaagcatcacatttacccaaacttccaactcttactacaaggcctatagcaacctttacataccacgccttggccacttggttaccacacaccagaccggttcgcactaaccggaacccgaataggcccactccgcaaattacggccccacaccctcaggccttttgaacttggacccagctcacccatattcaggtcctgcgcgaaagacctcctatttccaacacgtaatgcgggctaag

SEQ ID NO: 6883 - DNA, 1210 bp, Homo sapiens
ttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttcacagagattataactacaatgtgaagtgaatggtgccactgacagttatgcaaaccgtccagagcatagccacctgatcctgctgggattcctctttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacatggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataacccca

SEQ ID NO: 6884 - DNA, 1734 bp, Homo sapiens
tagccgcagagctccaccgctgaggccaacgaggccacactttcatttgcttgttacagatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatggacacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcgccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctaccccgttagtttcagaccgtttcctaagtccataattgtgtttctgcttctttctgctctggtttgcattcaatcagcccaagttgggtcacatagatgggtttcctttgggtacccctcaggctcctaatattcttgcccaggatccttggaact

SEQ ID NO: 6885 - DNA, 294 bp, Homo sapiens
acacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattctt

SEQ ID NO: 6886 - DNA, 1242 bp, Homo sapiens
cagctgggtttcaaaagcttgttgaaagtgaagtttggtgcttttgattgtatttgtttttataagattaccattgctttgcattccagatgcctctcttatccttaaggagagagaagacagaactgcttactcactctctggaactctcctagcctgatgggggaggaacagagccaccagtctgactttgcagtgccccaaacagtaacccacaaggcaacatacaggttaagacttggctctgccaccaacttctgtgactttgaccgagccatttctagtctcttggcctcagtttactcatctgtaaagtgaggggattgagtaggcaatagcagatcttttctagtacactttctatggttctcagtacaaggtgggcatgggaagctctttaatagtgtttctctcttcatctgtttttttgtttttgttttatttgtttgcttgtttttgagacagagttttgctgtcacccaggctggagcgcagggatacaatcctggctcaccgcagccttgacctcccagtttcaagcgattctcccatctcaacctcccaagtagctggaactactggcatgtgccaccatgcccagctaattcttttatttttttagagacagggtctctatcagttaaggttggagaatttatctgggaaggcttcctggaggaggtaaggaaaagaagtcagcttggagccagaattaagtattctgattaatgagggacctggagcattgtaggcttcggagcacctttttggctccacctactcctcaggaggaaaggcctgagtctgaggtttaatagatacagttttgttcctcctttccctgtaattacctggcctgagacactctcagactctgtccaccactcctgtccttcaactcctcccactgtcacctgaggataggctgtatctagattcacattctctacctcctactccagaagagtaggttgtagggcaggtgtcaaagaagagactcccaagctctagacctgtggtgtccaatatggcagccatgagccacacatggtgattgaacatggggagtgtggctggtctgaactgagatatgctgtacgtgtaaaatacacaacagattcagagccttcatgtgaaaaaagaatgtaaaatttcttattaatactttttatattgattatgcatatgttgaagtgatactttttacataatgagttaaataaaatgattaaaattaaaaaa

SEQ ID NO: 6887 - DNA, 561 bp, Homo sapiens
aggaaacagggaaaatggaaggcgggcggctctgcaagtccgacctgggtgccccagagagctgctccgggaaagacgtttacctgctgcccagagctgggactgcagaccctgattggcgagggcttggagagtagctgagaaccttcccttcagctactgaagaccagacagggctttctgtatcacgctgcctgacgatgatgagggtgcagtgactaagagtgcagatgaaaggcccagctctccaaccaggtggatggatttgcaaggagcttctatctgggcgtggtggctcatgcctgtaatcccagcactttgggaggctgaggcgagcgaaccacctgagggtgggagttcaagaccagcctgaccaacatggagaaaccccatctctactaaaaatacaaaattagccgggcatggtggcaggcacctgtaatcccagctactcgggaggctgaggcaggagaatcgcttgaacccgggaggcggaggttgcagtgagccaagatcgtgccattgcactccagcctgggcgacagagtgagactccatttc

SEQ ID NO: 6888 - DNA, 675 bp, Homo sapiens
gcggcttgctcggtactcagctgacttcctgtccctggaagagcagctgccggtatgctggggcagggcggtccccttcctgtggttcaggtaagggcataaccccatgccttcttggcatcctccctctctcctttctcaggctctgcaagtccgacctgggtgccccagagagctgctccgggaaagacgtttacctgctgcccagagctgggactgcagaccctgattggcgagggcttggagagtagctgagaaccttcccttcagctactgaagaccagacagggctttctgtatcacgctgcctgacgatgatgagggtgcagtgactaagagtgcagatgaaaggcccagctctccaaccaggtggatggatttgcaaggagcttctatctgggcgtggtggctcatgcctgtaatcccagcactttgggaggctgaggcgagcgaaccacctgagggtgggagttcaagaccagcctgaccaacatggagaaaccccatctctactaaaaatacaaaattagccgggcatggtggcaggcacctgtaatcccagctactcgggaggctgaggcaggagaatcgcttgaacccgggaggcggaggttgcagtgagccaagatcgtgccattgcactccagcctgggcgacagagtgagactccatttc

SEQ ID NO: 6889 - DNA, 998 bp, Homo sapiens
gggaaagaaaaaagtagggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttatttagtgccttgcctcaatggagcttaaagcatagcacataaattttatcttatttagccctggagcatcactaagaagcagctaggaactatggcttgccagacagattatgcttgtgccagagaagtggagaagcctgaaatcccttgtcaagtattccacaggaaggaaaggtagtctttgggctttggtctactgacctgtggattaaactctatcccttagattatcccatttctaaatacatttattcaatcagtatttctataatcacttagcatttgataggcttcttccttgatacatttaacataacgcctcagttgcatattacattatggaagaatatacgattgcttcatataacaacattctcatcaccagtgacagtgtcctactggtttgaagaaagatattcttggattatgtgttttatatctaaatggttattctgagactggttgtattttcttctcctactcgtgaaacgatgtgaacaagcattttaaggacaataaaaagttagctggttgaaaaaaaa

SEQ ID NO: 6890 - DNA, 559 bp, Homo sapiens
tagtagctgggactacaggcacacatcaccatgcctagctaattttttgtaatttttttgtagagatagggtctcactatgttgcccaggatggtcttgaactcctagcctcaagcagtcctcctacctcagcctcctaaaatgttgggattacaggggtaagccaatgcccctggcctctatgattcttgatatgcacatataaaggaccactaataaatgttttcacaaagtgagaacattaagataggccaagacaaaaagataggccaagacaagaacttcataaaacttctacttcagggcattaagaaatcagttgggtggggtgcggtggctcacgcttgtaatcccagcactttgggagactgaggcaggtggatcacgaggtcaggaaatcgagaccacggtgaaaccccgtctctactaaaaatacaaaaaaattagctgggcatggtggtgggcgcgtgtagtcccagctactcggagaggctgaggcaggagaatggcgtgaacccgggaggtggaggttgcagtgagccgagatcacgccactgca

SEQ ID NO: 6891 - DNA, 414 bp, Homo sapiens
ctctgccagtttatatgtacatatatttatgtaaaacattttctcccagctctttgccagctgttccacattttccagctgccacttcagtttgaaatgatggactgtctgcgtctccaagtcaaagaaccctttagtcaaaggtatggagggccggccgctgtgcaaatacatggcagtgccattagccgggctggtattattagttctaaaaaatacctcctgctccccttttcctctcctccctcttctctccagttaggctttccagagcacagtatatacactttgctgaaaattcgagtaattaggcctttccctcttaaatgtgatttttgtacagaatttggatgaggccgtttttttagatccctgaaatatgtgtctggtggaaataaattaacttttaaaaat

SEQ ID NO: 6892 - DNA, 482 bp, Homo sapiens
gcccatcctataaccattcataacaactcagattatagagacttgggtgaagtgttcatctttgaaggctggtcaaccccactgaagtagcagggactgaaagtagggaagggctgggtttccaaaggttaatctaagtgttgctacccaagggttgctgtgattcgaaaatcataactggtcaagtgtggtggctcatgcctctaatcccagtgctttgggaggttgggcagtaggattgtttgatgacaggagctcaaggccagactgggcatcattgcgagaccccaactcaaaaaaaagtagttaaaaagacattagccatgtatagtggcacctttagttctaggtactcaggatgctggggtgggaagattgcttcatcccaggagttggaggttacaggttacagtgagctatgatcatgccactgctttctagccttctagcctgtatgacagagaaaaagaccttgtctctga

SEQ ID NO: 6893 - DNA, 513 bp, Homo sapiens
aatggaaacaatggctccagtttggaatgcagtgtgttgcccaaggtgttcagcatgatgagttagcattcaacgcacaaagtactaactacaaaggaagccaaagctgccctgcaccatgaggttcagtgactttgatggtggtgatacaaatgatgcttgacaccaatgtgacctgactcaatcacttacccgtaatgtcttgctggatccctgtcccacccagcctttcttcacatgcagctaaaggggcttgacttctgcctacaatcaaccctaacccaggaactagactacttctcttcttacagatgatttaagtcctactttacagatgatgaaactgaggtccagagaaactcagtgcaagtctaagatcaaagaattctagaaatctagtgtctggacttccagtccaatataaccaaggatggatgaataaagagactccatttataatgttaatcttatgctaataagtgaaagtgaatgtaaatctgtgcatacagaatg

SEQ ID NO: 6894 - DNA, 311 bp, Homo sapiens
aggaggtggatctagcccccatcctaactcgctgagttcctctcttggagagagtactgctaccagaactgttgtccaggcaggtgctcctgtaaagatatgctaaacatcgaagtgtggaatgatcccacatttctacttggctgaacatgtggcactggttgcaagtggcctcatggctgttgacaggaaaaaagaaaaagcaggccaggtgcagtggctcacacctatcatccccacacttttggaggccgaggcaggtggattgcttgaacccagcctgaacaacatagagagatcctatctctaca

SEQ ID NO: 6895 - DNA, 701 bp, Homo sapiens
  misc_feature (632)..(632): n is a, c, g, or t
aaacattcagctctaaagaaataatcacaaagcacctcggtgcctgatttttgcaaggcagtccttgccggaggatcgggcattcgtgcacattcacccggagaccgtgctgtccacttccagaaggggaggaagggcagcgctcagaagcacgcccagactgtctccagccctgctagtccacgcctggctgaggccatctcgcctgctcagcccccaagttcccccacagtccatgtccctgggttatgaatgtcacctggtgtctgtcagatccccaccccattgttcttgtcaatgagcaggagtggggtggacctgccatcctgcgaatcctttacagcctgcagcgctccctgccaactcttcacaaccattagcacccactaacaatccatttcccctggagctcttcactctaaagatagaagaccaaaaaatagaagtgtcctcatttctcacagtactacaggaggaggtgagaaccgatgcatccgtgcatcttaggagaatctcatttcagacctcggctttgagtgcgcctcctgctcagtcagccctctccctcgctgcaggttgacgtgggtcagacagtgcgcagtcaggcagcctgattttcggttctggggttnggtccaagattgaccgggtcccttttgttcacttgccccctcctgtgcaaccccctgggtttgtctgcc

SEQ ID NO: 6896 - DNA, 636 bp, Homo sapiens
aaacattcagctctaaagaaataatcacaaagcacctcggtgcctgatttttgcaaggcagtccttgccggaggatcgggcattcgtgcacattcacccggagaccgtgctgtccacttccagaaggggaggaagggcagcgctcagaagcacgcccagactgtctccagccctgctagtccacgcctggctgaggccatctcgcctgctcagcccccaagttcccccacagtccatgtccctgggttatgaatgtcacctggtgtctgtcagatccccaccccattgttcttgtcaatgagcaggagtggggtggacctgccatcctgcgaatcctttacagcgggggagaaggctgggactggaatgtggggtgctctctaggaaagggggaccaccccagcagatgcagaattgcccagggaacactctggagcctgtgatccccaaaccggctggggaagagagcctgatttgagggggctgggggtttagataagaagattgagccaaagcttgggagcagtgaatgctggagctaaggagctggaaccccgaggcagagggggcctttgggagttatttaacagagaaatgcattaagaagggattttagggacccagcagccaaccggg

SEQ ID NO: 6897 - DNA, 417 bp, Homo sapiens
gagaggccagctgccatgtcatgaagacactcaagaagccctgtgaagaggaagcaaggcctgccaacaacagccagcaccaactttccagccaagggattgagccatctcacagtggatcctccagcccccaccaagccttcatatgaccaaaccaataccaacatgtaactgtgacctcatgtgagtccccaagccagaatacccatctcctgtctcagaaatgatgagaaataataaatatatgtgctcacacacattaccatctaattttctacaatatatgtttatttccccactgtatataagatccaaggactgtttttttttttcactgctatattccaagaacctagaacaaatctggcatatggtaagtatacaataaatatctgttgaattaattaatgggaaaaa

SEQ ID NO: 6898 - DNA, 272 bp, Homo sapiens
tatggaggcagccctgttaccagtctctggtggttgccaaaacaaatccaaagggagagtttatttcgtgtctcttctaggtatctgtcttggagagttttgctgtgcagcttttaatttgccttagtaaaataatgagtaggttaacaataaaagttgttttgtaactttgaacatgacctaacaaaagtactaaaagttgtaagctcaggaaggaaaaataaaatacacgggaaaattttaacgtcactgaaattgtgaaactccgtctc

SEQ ID NO: 6899 - DNA, 433 bp, Homo sapiens
tagctctgtggcagctcagcccggccatgcttccttctcagctggagcaggaattttggttgctaggatcctggcgagcctcagccggctactcctttctctccctcctccaccagccactgagtccttgtgccccgacccagccccagccggggtctgtgggtggggcagcactcccttctggttcttagttgccatggaccttaccctctggcaggactcctgctgtcctctcctgcagggtggatggcaaaatgggaccagcacagctcctgatacaatgaaccctgggctctaatcccagccctgccatgtataagctgtgtgacctcaagtatgtgaactcatctctctgtgcctgtttactccctaacatgcaactaacagtagtactctaccctaagagctgttgtgaggctttcctcaccttttt

SEQ ID NO: 6900 - DNA, 584 bp, Homo sapiens
acagtgtaatttggtggagtatacacattttggcaaacagttggcattaactgtatttgccaatattaaatttagtaacagatcaggcacttggccagcaggtgaggaaagtttggtcatgtaaaaaactgaatacaggaggagaaagaaaaccagattcgttaagcacccacaatatcagatccattaatttttttatctccataattcctcagtgaagttggtaagtattcctgctctacaggtggggagtctgaggtctaggtattttaggtaaattggcttggattacatgtatgtctaataaatccagatggatattaccacacagcttatctatactatttctagtaaactgcatcctgtgataaacttgtagagaatcttactgttgtttttctttatactcttccctggttcccataaatccaaggatttaaagcctcaaaaaaaacatgcctttcggccaggcacggtggctcacgcgtgtaatcccagcactttgggaggctgaggcaagcggatcacttgaggtcaggagtttgagaccagactgtccaacatggtgaaaccccatctctact

SEQ ID NO: 6901 - DNA, 384 bp, Homo sapiens
  misc_feature (30)..(31): n is a, c, g, or t
attgaaaggggaaaattgagagagctagcnntccatggtcttggtcttccataaaggggaactgggacatccactggaggcggctctgatgcacaagtaattacatttgcacagacacagatgacacagacagtggatggagtcgctctggtgctcacagaggagcccgcctccagccaacacctgaatgtcactgggttggggggaataaaacctgtttggacctgatgatctctttgggggaagaagtgagcccacatttgagaccctttccggagagccagccactccagcagatgggaagactggcttgtgcccggtaccggaaagaaaccagatggtgactcaaacgaacacagacccaaggcctcacgcacagatttc

SEQ ID NO: 6902 - DNA, 2407 bp, Homo sapiens
  misc_feature (1766)..(1766): n is a, c, g, or t
gcgcatctgccggatggtgcggaggcggcacggctccggagccggagcgcacgcgcgccgagctcgagaaactgatccagcagcgcgccgtgctccgggtcagctacaaggggagcatctcgtaccgcaacgcggcgcgcgtccagccgccccggcgcggagccaccccgccggccccgccgcgcgcccccggcggcgcggcgcggcccgtgagcctgcgggaagtcgtgcgctacctcgggggcagcggcggcgccggcggtcgcctaacccgcggccgcgtgcaggggctgctggaggaggaggcggcggctcgaggccgtctggagcgcacccgtctcggagcgcttgcgctgccccgcggggacaggcccggacgggcgccgccggccgccagcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6903 - DNA, 2345 bp, Homo sapiens
  misc_feature (1704)..(1704): n is a, c, g, or t
gcgcatctgccggatggtgcggaggcggcacggctccggagccggagcgcacgcgcgccgagctcgagaaactgatccagcagcgcgccgtgctccgggtcagctacaaggggagcatctcgtaccgcaacgcggcgcgcgtccagccgccccggcgcggagccaccccgccggccccgccgcgcgcccccggcggcgcggcgcggcccgtgagcctgcgggaagtcgtgcgctacctcgggggcagcggcggcgccggcggtcgcctaacccgcggccgcgtgcaggggctgctggaggaggaggcggcggctcgaggccgtctggagcgcacccgtctcggagcgcttgcgctgccccgcggggacaggcccggacgggcgccgccggccgccagcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6904 - DNA, 2503 bp, Homo sapiens
  misc_feature (200)..(200): n is a, c, g, or t
  misc_feature (204)..(204): n is a, c, g, or t
  misc_feature (1862)..(1862): n is a, c, g, or t
agcggggggagccggggaggggggcgccgcgctgggagggaggcagcgcgcacggtgcagccgggccgggcgggaggcatggcggggccaccggccctatccccgccggagacggcggcggccgccaccacggcggccgccgcgctcgtcgtccgccgcttccccgcactaccaagagtggatcctggacaccatcgacncgcngcggtttcctgcgggctcggtgcgtggtgaccttggcaagtgattgaatctcccggagcctcagtttcctccgctgtaaacgcggtttaataacagtagcgaccccttggggttgttgagcgagtttagtaagatttggttgtcgagggctttagttaacacagagcctggcacggagtgaatgcgtaaaagttagtccgtattgttcttaaaggtggaatcggttcctcctccccaccgcccggacgccacagtcagggtctgggattagaacagctactaattttgcatgcttctctcctcggctccagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6905 - DNA, 2215 bp, Homo sapiens
  misc_feature (200)..(200): n is a, c, g, or t
  misc_feature (204)..(204): n is a, c, g, or t
  misc_feature (1574)..(1574): n is a, c, g, or t
agcggggggagccggggaggggggcgccgcgctgggagggaggcagcgcgcacggtgcagccgggccgggcgggaggcatggcggggccaccggccctatccccgccggagacggcggcggccgccaccacggcggccgccgcgctcgtcgtccgccgcttccccgcactaccaagagtggatcctggacaccatcgacncgcngcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6906 - DNA, 1517 bp, Homo sapiens
  misc_feature (876)..(876): n is a, c, g, or t
ataagcggtccggaatggcgacattcaagagcagaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6907 - DNA, 1474 bp, Homo sapiens
  misc_feature (833)..(833): n is a, c, g, or t
tggaatccagtgaggaatcagacattattattcaactcagcgtgcaacagcatatcccgttgtgatactgagaaatgctttcctcttgagacctttgggaggacagccatttacacaagaattccctgcattcacttttgaattacctgttagctgtagaactcagccaggatcttggcctcgtgccggcacgaggccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6908 - DNA, 2131 bp, Homo sapiens
  misc_feature (1490)..(1490): n is a, c, g, or t
cggacggcgtgggtcgacccacgcgtcgggcggcggctcgaggccgtctggagcgcacccgtctcggagcgcttgcgctgccccgcggggacaggcccggacgggcgccgccggccgccagcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6909 - DNA, 2036 bp, Homo sapiens
gcgcatctgccggatggtgcggaggcggcacggctccggagccggagcgcacgcgcgccgagctcgagaaactgatccagcagcgcgccgtgctccgggtcagctacaaggggagcatctcgtaccgcaacgcggcgcgcgtccagccgccccggcgcggagccaccccgccggccccgccgcgcgcccccggcggcgcggcgcggcccgtgagcctgcgggaagtcgtgcgctacctcgggggcagcggcggcgccggcggtcgcctaacccgcggccgcgtgcaggggctgctggaggaggaggcggcggctcgaggccgtctggagcgcacccgtctcggagcgcttgcgctgccccgcggggacaggcccggacgggcgccgccggccgccagcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacagcttctgttgccaccgggccagactccccgtcccccgtgcctttgcccccaggcaaaccagccctacctggggccgacgggaccccctttggctgtcctcccgggcgcaaagagaagccatctgatcccgtcgagtggaccgtgatggatgtcgtcgaatattttactgaggctggattcccggagcaggcgacagctttccaagagcaggaaattgatggcaaatctttgctgctcatgcagcgcacagatgtgctcaccggcctgtccatccgcctcgggccagccctgaaaatctacgagcaccacatcaaggtgcttcagcaaggccactttgaggatgatgaccccgatggcttcttaggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaaaaaaaaaaaaccctcgagttttttattgtttattatcttttttcgtgggcgctgaggcgaacttcgatcacactgtatcacaacatcgtctgacctaagactgctctttggtctctccaccattattagagagtagataaactagctccaccacacagcttatgggcgcccccacggaggtgacatcagagagaggaaaacattacacacacagcgccaacgaagcccgccagacaacacacggtcacgcaaggaggggcacagcagcacacagagtcatacaccgcgtgtggaacacagagacaccgagcacaacatgcagaacgaagagacgcgtgcgcaaatagtctacctacgagaagatctacacagtatacacacaagcaaccacgcacaatctaccgccaaaggaaacacagcacaaaaaaatcgatacaggagccacaagatgatgaggcgagggcacaacgcccagcagagacagaataaatctatcctaataacaaaacccgccccaagagagacgagacaaactaacagagcgcagggggggcacccaaccaaccaacgccacaatgcgagcgacgacacgccggggcagcaacaatcaacacaacagaaaataagatgatgacagcccgctatatataaacaacccgcaactttggaggaaagaaataaccgggcgagg

SEQ ID NO: 6910 - DNA, 1697 bp, Homo sapiens
  misc_feature (1056)..(1056): n is a, c, g, or t
gcgcatctgccggatggtgcggaggcggcacggctccggagccggagcgcacgcgcgccgagctcgagaaactgatccagcagcgcgccgtgctccgggtcagctacaaggggagcatctcgtaccgcaacgcggcgcgcgtccagccgccccggcgcggagccaccccgccggccccgccgcgcgcccccggcggcgcggcgcggcccgtgagcctgcgggaagtcgtgcgctacctcgggggcagcggcggcgccggcggtcgcctaacccgcggccgcgtgcaggggctgctggaggaggaggcggcggctcgaggccgtctggagcgcacccgtctcggagcgcttgcgctgccccgcggggacaggcccggacgggcgccgccggccgccagcgcccgcccgtctcgcagcaagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaaaaaaaaaaaataaaaaaaagaaaaaaacagaaaaaaaaaaagaagaagagggggggcggcgcgcgctaataaagatatttctctccgaagtggggggcgccccccangtcttacccggtcctccccgcgttgttttttttattaaagcagcgaggggccgccctatttagaggagagcgttatatatatatctaactcgcatagcgcgccttgggcgcccgcggtttttttatccacaacacgcgctcgcgagggcgagtgggagacacacacgcgctgagctctatcgtgcgtgaggatacatctcttgatggggggagacgcgagcgacaccccccctatattgtgtctggcgggggggggggagcgagaaccacatatctgtgtgaggcggacaccacaccaatttctcttctctatatgagacgagatctattttatactaacgtactctctctcatgagggcggcgatcataacatatcatctaaaatcactctcttttttctgagcaacggcgtggtggtgatactccgcagtagtgcggtgtgccgctcaaaacaccacccatctatgtcgcggtcgctgccttatgattttgtggttgcgctgcggcgcgatcctctgcgttagaaaacaacctgttttttgtcggggcatctacagcgcggggcaaggtttattgtgactatcttgcgttcgcaaaaatctatatttttttcttcccgcgcgcggcggacgccttcccc

SEQ ID NO: 6911 - DNA, 602 bp, Homo sapiens
ggtatcattcttctgagccctcttcatgtgcattgtcttggcatttaaagtaggagtttgtgtgtacatgaacacgagtatatgtacacatgtgtgatcttcccatttacatttaagatcctcgagcagtgtttttcagctttgggctcctctggtctctggggattacgaagaggtagtaatggcttcattacagcttatcacagggacactgctagagatgtaaaaatgagtgagacatggtccctatctataggaaattcagagtgtgggacgggctccagtcatagaaacagaatttcaatacggtatgctgagagctgtaatacagacacgcacaggatgcagctgtaggtgtgtgcgcttcaggaggtcttcttcagaaagtttatcactggtcacatgtttatcccacaacgggttttcacattttaattagaatgtcagctttttctcttggttggcatttttttcaactcagtatgatcattctagatgtttcctgctgatgaaatttgattgacattttgtctttgatttaaaaaaataaaaaaaatgatgaagttgtaagctaataaatgcagtttggcagatgaaatctt

SEQ ID NO: 6912 - DNA, 416 bp, Homo sapiens
ccatgttggcccggctggtctcgaactcctgatggcaaggtgatctgcctgcctcagcctcccaaagtgctgggattacaggcatgagccactgagcccggctgtttttttgtgttttttttgttgttgtttgtttgttttttttttgagacagagtcttgctctgtcgcccaggctggagtgccagtggcgcgatttcagctcactcaggagtgagccaccacacctggcctgtgattggctctattttgagtgattacgtgtaaatcatctagaaccagctctgagcaatggcgttgcggtgtccctccctccccgctggggccataccagcccctctccactgggagcccaagttgccaatgactgtggccaaactcccccatttttgtctgtatcctgctctctttaggtta

SEQ ID NO: 6913 - DNA, 445 bp, Homo sapiens
tattttgtgttaatcacctaatatcattcctttggattaaggtctcttttggaccataaacagaagtatcttaccagctatgcaagtctatttgtgtcagtatccttagtgtttttgatttatattttaaaataaaattcctgtttttctatggctatttaattgaaacagtatgatactccttcctaacactggctaaaataaagcaatttctcttccttctctgttctaattttctcccatttttcttcaacaggctattctagggaagagtatttttctaggtctcaaagcaattttatttaaaaaattgtatgtgaagaatttatttgacagctgaggtttcaagaacatttaaaagtactgtatgatagtgtattttctgaagttttactttttaaataatcattgttctatgtaaaggtatacttacataggtccccta

SEQ ID NO: 6914 - DNA, 2821 bp, Homo sapiens
gcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttaccttcctctctcctcagcggccgtactttgcgccgtacctcacctggcctgcaggatgaagaaccccatgctggaggtggtgtctttactactggagaagctgctcctcatctccaacttcacgctctttagttcgggcgccgcgggcaaggacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggcagaattcagcaatatgagaaaccagcccctaaaatgatagccacaagcagattaattgtgttttttttctcctgtaatccttgtactgttcggctgaatttgaagattggaagcttatattgagaccagtaactttactgtaaatttactttgtttcattgaaaaaagcaaattgataaacatattaaactggaagaattttcaaatcgaaaacatgtttgatgactggggaaaaaataagctcgataatctatttttttcatgtagtatataagtcaagaatgttttattgtcattatgtgaaaccaatattggcaaatagtactttaatgatgaagcaaatgaccagaaattatagaaatctgagttttcctgtaaaaatagcactatagtatcacttgaacaatttgatttggctttacttactaggaagcctggaattcattatttttttccttttatgtgcccactgtggctactttaaatcactctgagaggtaaatggatataggattgaagttatgtgggtatttggccatgtgtgtgtgaaataaatatgtagatagtcacatatacaccagactgagagataaaattgttcttgattgccttattatccatccatacctaggtgtggtccattaatagggtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattattgaaaataattttaaagtggcttagtactgccagtcatgtaaattgattctgctgagggtcttataagaattgagatataacaatggtaaaacaagcattcaagcacttttacaaaattaccaaattcttaaaatcgaagccacagctagacttgcatttcaggtattaaaattgctttcttaactgtcaagaatcacaaaataacaaatcatattatgagtgaatatggggagggcggggcaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagttgaaggagattcgatttctgaaaaaatatagtgtcctcaaataattgaattttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttca

SEQ ID NO: 6915 - DNA, 2364 bp, Homo sapiens
ggcaatgcaggaccgcttccagagattccagagctgcccagtattgctgcagaagtcatcaggtgtccacccacagtgtagttcaaacgacaaaggcacgtagaagaatacagaggacttgtgcatcaaacatctcagttaatcctcagaacaatttgagtgttcccatttgactacttgaggtgacatagccaataagagctggagccaggactcagacataggccatcatttctaagtaaaattatttttctaaggaaaacattacacatattagaaggatgcattcctcagggttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggcagaattcagcaatatgagaaaccagcccctaaaatgatagccacaagcagattaattgtgttttttttctcctgtaatccttgtactgttcggctgaatttgaagattggaagcttatattgagaccagtaactttactgtaaatttactttgtttcattgaaaaaagcaaattgataaacatattaaactggaagaattttcaaatcgaaaacatgtttgatgactggggaaaaaataagctcgataatctatttttttcatgtagtatataagtcaagaatgttttattgtcattatgtgaaaccaatattggcaaatagtactttaatgatgaagcaaatgaccagaaattatagaaatctgagttttcctgtaaaaatagcactatagtatcacttgaacaatttgatttggctttacttactaggaagcctggaattcattatttttttccttttatgtgcccactgtggctactttaaatcactctgagaggtaaatggatataggattgaagttatgtgggtatttggccatgtgtgtgtgaaataaatatgtagatagtcacatatacaccagactgagagataaaattgttcttgattgccttattatccatccatacctaggtgtggtccattaatagggtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattattgaaaataattttaaagtggcttagtactgccagtcatgtaaattgattctgctgagggtcttataagaattgagatataacaatggtaaaacaagcattcaagcacttttacaaaattaccaaattcttaaaatcgaagccacagctagacttgcatttcaggtattaaaattgctttcttaactgtcaagaatcacaaaataacaaatcatattatgagtgaatatggggagggcggggcaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagttgaaggagattcgatttctgaaaaaatatagtgtcctcaaataattgaattttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttca

SEQ ID NO: 6916 - DNA, 2673 bp, Homo sapiens
atcacagaatgtagccacctttcttaacggtccgggaaaccagaggtctctccagctactcagggatgaagaaccccatgctggaggtggtgtctttactactggagaagctgctcctcatctccaacttcacgctctttagttcgggcgccgcgggcaaggacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggcagaattcagcaatatgagaaaccagcccctaaaatgatagccacaagcagattaattgtgttttttttctcctgtaatccttgtactgttcggctgaatttgaagattggaagcttatattgagaccagtaactttactgtaaatttactttgtttcattgaaaaaagcaaattgataaacatattaaactggaagaattttcaaatcgaaaacatgtttgatgactggggaaaaaataagctcgataatctatttttttcatgtagtatataagtcaagaatgttttattgtcattatgtgaaaccaatattggcaaatagtactttaatgatgaagcaaatgaccagaaattatagaaatctgagttttcctgtaaaaatagcactatagtatcacttgaacaatttgatttggctttacttactaggaagcctggaattcattatttttttccttttatgtgcccactgtggctactttaaatcactctgagaggtaaatggatataggattgaagttatgtgggtatttggccatgtgtgtgtgaaataaatatgtagatagtcacatatacaccagactgagagataaaattgttcttgattgccttattatccatccatacctaggtgtggtccattaatagggtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattattgaaaataattttaaagtggcttagtactgccagtcatgtaaattgattctgctgagggtcttataagaattgagatataacaatggtaaaacaagcattcaagcacttttacaaaattaccaaattcttaaaatcgaagccacagctagacttgcatttcaggtattaaaattgctttcttaactgtcaagaatcacaaaataacaaatcatattatgagtgaatatggggagggcggggcaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagttgaaggagattcgatttctgaaaaaatatagtgtcctcaaataattgaattttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttca

SEQ ID NO: 6917 - DNA, 350 bp, Homo sapiens
ggagcatttcagatttcggatttttgtatttgggatgctcagcccttatattatttcagctagtaaccaggtcaaaacttcgttatcttacttgtttataacctagccagccctttataattttttctctacctcccttttttcttctggtttgacatttttagttcagattattagtttttattgaacatcagcagagtgatgaaaaacagattttttaaaactattcttcagaaattgatagcaatctgcctactcctgtttatgactgagaactgtacatacatttcactcactgtagttaatattgagctcccccagacatagataatccactttggatttttctg

SEQ ID NO: 6918 - DNA, 836 bp, Homo sapiens
agaaacgaaacaaatgaagtgccctagcttattgtctggaggcatagcacagagaagggaaacccaaagagagcccagtagtcttgctgagctgaagagttaagacagaattagcaaaacagagtacctgaaggtaggtactgcacagacaggaggtagctgcacagagagaaagctccagaggtccacaggggggttctcccaagcctttggctgagtattcatctgcatgtactgtgacatctttgagactggggaaagagtcactgtggaaaggagtaggtggagcaatttccagacctcacacagggctgggaatagtttgtatttccactaagcagagtaagagtaacaagaccttctaccatactgagcatcaagtccttagaagcatattgcctcagtaatagagccaagttagcccttgacaaaaggctgatttggatcttccttgataaagcttaaaagcaagccttaacgggttctaattaatttcagctaaactaaatagttcccagaaaaaaaagcctcaacatatttaaaggaataatttaaaaaaaatacagcacccaacaacataaaacttcagatgtttgacattcaccaaaaaattaccacgcccaaaaatatgtccagtaactgggggaaaatacagtcaacagaaacagtccctgaagagacccagataatagataaggacattaaaatatactccaaggctgagtgcagtagttcacctctgtaacaccagcactttgggaggccaaggcaggcggattccttgagcttaggagtttgaaaccaccctggacaacatggtgaaaccctgtctcaaa

SEQ ID NO: 6919 - DNA, 438 bp, Homo sapiens
ttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggttt

SEQ ID NO: 6920 - DNA, 328 bp, Homo sapiens
acgaggatgggctgcatgcatgctgagtaaacatgcctgttacatgcaacccatgttcactttggggtggagacaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctcccagtctgtcagaatggccacttgcaggctgtaaccctttataaaaaaataaaatctcctttctaaatttaaaaaaaaaaaa

SEQ ID NO: 6921 - DNA, 2341 bp, Homo sapiens
tgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggcgctttcagcaccgaatcctagccactagacaaccatgcagatgcggaaagctgctttctctcccttcttcgacctgaagcgacactttcctgtgctctaggaggacttgggtcttgtgagagtctccctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgccaggcggcagcaactgacaagatggtcgcgggtcgccgggtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgaggcgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccaccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcgctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctcccagtctgtcagaatggccacttgcaggctgtaaccctttataaaaaaataaaatctcctttctaaatttaaaaaaaaaaaa

SEQ ID NO: 6922 - DNA, 2484 bp, Homo sapiens
tgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggcgctttcagcaccgaatcctagccactagacaaccatgcagatgcggaaagctgctttctctcccttcttcgacctgaagcgacactttcctgtgctctaggaggacttgggtcttgtgagagtctccctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgccaggcggcagcaactgacaagatggtcgcgggtcgccgggtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgaggcgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccaccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctcccagtctgtcagaatggccacttgcaggctgtaaccctttataaaaaaataaaatctcctttctaaatttaaaaaaaaaaaa

SEQ ID NO: 6923 - DNA, 214 bp, Homo sapiens
aagagctagagctgacactcggcgatgagctaagacgctgtttcagagcgtttgggtcctctgaggccccttgaccaggtgagcggaccctggagctgggccccgggctggggcggaactgcggcctaggggcctagggagcagctgcttcccggcgggtgcagagaatcttccctcgaccgagggggcggggtccgtagcggaggtgtcggcc

SEQ ID NO: 6924 - DNA, 2700 bp, Homo sapiens
aagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggtggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaaaaaaagca

SEQ ID NO: 6925 - DNA, 2288 bp, Homo sapiens
tggtaaacagagtacaaccttctgctgcatatttttcatccattcagcgcaattttaagtagatattaaaggagtgtctctgaagatacagtccaaagaaagttctccaaaacaaggagaacagtctgaagctggggatggcaacagcattggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaaaaaaagca

SEQ ID NO: 6926 - DNA, 2020 bp, Homo sapiens
aagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggtggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagta

SEQ ID NO: 6927 - DNA, 2295 bp, Homo sapiens
aagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaaaaaaagca

SEQ ID NO: 6928 - DNA, 3030 bp, Homo sapiens
aagagctagagctgacactcggcgatgagctaagacgctgtttcagagcgtttgggtcctctgaggccccttgaccaggagtgtctctgaagatacagtccaaagaaagttctccaaaacaaggagaacagtctgaagctggggatggcaacagcattggtgagtgcccattccctggctcccctgaatctgaagaaggaggggcttcgggtagtgagggaggatcactactctacttgggaacagggattcaagctgcaaggaaacagtaaaggccttggacaggagccattgtgcaaacaattcaggcagttgcgttatgaagagaccacaggacctcgagaagcactaagtcggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggtggtaagggtcagatgtgctctttttcaggaatgcaggaattgagatctctggccagacaggtggacatgggctcatcagcggaaggagaattactaagctttgattcagtttttttccagtctagctgttaatttccttaggtcttacctcaaccttacctggcccttgcttggagaaaactgaatgtgcaccagattccccatcttcttttctttgcccctctggggtttctctttcttctcttttttaacacctaggtgttttactgaacagcagtttcctaaacccacatatatctaattatgcctccatatacctaattgtccctaggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaaaaaaagca

SEQ ID NO: 6929 - DNA, 2096 bp, Homo sapiens
aagagctagagctgacactcggcgatgagctaagacgctgtttcagagcgtttgggtcctctgaggccccttgaccaggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaaaaaaagca

SEQ ID NO: 6930 - DNA, 788 bp, Homo sapiens
gaaactcttgccatatatccatattcataatcattattcttcctgtgctaaaaagtacttctgaggatgaccttcattctcctatctaaattttagagtacttatgttgcaaccttctaagcccagtgatagtctgtggatgaaaggattaatattgcttagctttatgttggatttaagtgtaaatgtccatgattgtctctaacagagaagcaaatggaacccattttctcacatagaggtgcagggactgattgggtggctgcccttcagattataattgggctgaaagatgcagtatgttcagctaagaatacatcctggtgccagggagttttgtcccttaataatgttgctttgccatataagctttgcctcccagggagactctgagaatggggcagcagaatgagaaagaaaagggaaagagactgtgcttcagtttttgaaagatagagaaaattgctggcaattacttttagaagcagaaaatttgctatacagtttcatgtaaccataagcaagaacctgctttctcaattccttcccctgttccctcaacccttttggacagtctggtcctgagggtgcctttccatattacctttggctattgaaataaataattatttaaataaatgtttggaagttgctaggagattaaagttaaaggaaaggaagttaggaaccatgcagaggagcggtttttgagaaacaacaatctccggtttggggcataataggtgctcagtgagtatttgatgattagtactataatttataagcaa

SEQ ID NO: 6931 - DNA, 339 bp, Homo sapiens
caaaggatggatgtgatataagcacatcttaaatatgatggtgataccacatacttcatacctcatatgtgagatatatacataactcactaaaatattgaaactattccgatttttaattgtgggaagaagttaaggaattcattggcacacttaacagaaaaaaatcaatgttcattttaccatgtttcaaatagtacttgtgtagctaaaaccaattcctagtataataatgttaaaataggagtagaaacacaatggccaggctcagtggctcacacttgtaatcccagcactttgggaggctgagatggaggatcacttgaacctgtctcaaaa

SEQ ID NO: 6932 - DNA, 387 bp, Homo sapiens
gaggtcatcttgcaaactaaaatgaaaaatggtcagataaatttaaacttttgtgttctcacaatttagctctgtgccaggcactttaaaggcaatcagtaaatatttgttaaacgaatgaaaagtagatttctttcagtttttgtgctgagagtttaagtgaaagtaagccgtttgctttatgtgatgcttagatgcttagaattttaggctcttattgctggaaaaggcctttaagatctagtccaggttttataaaagcgtcttgtgggccatcactggaagacagagttgggcaacagcaagaagaggcttaagcgagtgaaagtggctcatcctgcttccctcactcccttccaaatacccctgagtgggcattcaactctt

SEQ ID NO: 6933 - DNA, 6733 bp, Homo sapiens
atgggcttcttgcccaagcttctcctcctggcctcattcttcccagcaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcatggctgaggtccaggtgagcccagcaggtcccatcctggagaaccagacagtgacactagtctgcaacacacccaatgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccacccgcctctcactccagtcctgacagccttcctggagacccaggcgggacttgtgggcatccttcactgctctgtggtcagtgagcccctggccacactggtgctgtcacatgggggtcatatcctggcctccacctccggggacagtgatcacagcccacgcttcagtggtacctctggtcccaactccctgcgcctggagatccgagacctggaggaaactgacagtggggagtacaagtgctcagccaccaactcccttggaaatgcaacctccaccctggacttccatgccaatgccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaagctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacacacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagaaggaggcgtgtttgtaagcagagcatgggcgagaattcggtggagatggcttttcagaaagagaccacgcagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggccgggtgaactttgtgtagccgaggccgcaccctccctcattccaggctcattcattttcatgctccattgccagactcttgctgggagcccgtccagaatgtcctcccaataaaactccatcctatgaaaaacggaaagtgaatc

SEQ ID NO: 6934 - DNA, 392 bp, Homo sapiens
gcctcgggcagtggactgacccctggggcactgagaagggctgctctaagtgtgcatttctcggggcagggcagaatttgggagcccagctggggcaccttctctggggcaggtcgcagggctctgtggcaccctgaggcctgtatcaccctcccctctgtccccctgccgttcttcccccaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgc

SEQ ID NO: 6935 - DNA, 7899 bp, Homo sapiens
atgggcttcttgcccaagcttctcctcctggcctcattcttcccagcaggccaggcctcatggggcgtctccagtccccaggacgtgcagggtgtgaaggggtcttgcctgcttatcccctgcatcttcagcttccctgccgacgtggaggtgcccgacggcatcacggccatctggtactacgactactcgggccagcggcaggtggtgagccactcggcggaccccaagctggtggaggcccgcttccgcggccgcaccgagttcatggggaaccccgagcacagggtgtgcaacctgctgctgaaggacctgcagcccgaggactctggttcctacaacttccgcttcgagatcagtgaggtcaaccgctggtcagatgtgaaaggcaccttggtcacagtaacagaggagcccagggtgcccaccattgcctccccggtggagcttctcgagggcacagaggtggacttcaactgctccactccctacgtatgcctgcaggagcaggtcagactgcagtggcaaggccaggaccctgctcgctctgtcaccttcaacagccagaagtttgagcccaccggcgtcggccacctggagaccctccacatggccatgtcctggcaggaccacggccggatcctgcgctgccagctctccgtggccaatcacagggctcagagcgagattcacctccaagtgaagtatgcccccaagggtgtgaagatcctcctcagcccctcggggaggaacatccttccaggtgagctggtcacactcacctgccaggtgaacagcagctaccctgcagtcagttccattaagtggctcaaggatggggtacgcctccaaaccaagactggtgtgctgcacctgccccaggcagcctggagcgatgctggcgtctacacctgccaagctgagaacggcgtgggctctttggtctcaccccccatcagcctccacatcttcatggctgaggtccaggtgagcccagcaggtcccatcctggagaaccagacagtgacactagtctgcaacacacccaatgaggcacccagtgatctccgctacagctggtacaagaaccatgtcctgctggaggatgcccactcccataccctccggctgcacttggccactagggctgatactggcttctacttctgtgaggtgcagaacgtccatggcagcgagcgctcgggccctgtcagcgtggtagtcaaccacccgcctctcactccagtcctgacagccttcctggagacccaggcgggacttgtgggcatccttcactgctctgtggtcagtgagcccctggccacactggtgctgtcacatgggggtcatatcctggcctccacctccggggacagtgatcacagcccacgcttcagtggtacctctggtcccaactccctgcgcctggagatccgagacctggaggaaactgacagtggggagtacaagtgctcagccaccaactcccttggaaatgcaacctccaccctggacttccatgccaatgccgcccgtctcctcatcagcccggcagccgaggtggtggaaggacaggcagtgacactgagctgcagaagcggcctaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgtgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaagctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacacacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttggacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagaggtgaggggagggggctccatctcccaggccactctgcacaaaagcccagctcttaggcccaaaggcttccttccctgtatccctcctgctgcagcatgatttgcctgtcgactctaaactgattgctcggggcacccttgtgtggagagcttcagcgataaagcaaaagttagaaggtgtcatcttgggtgggtccccttggaaggaagcactgggggcctgcagctgtggctgctctgagtcccgctctgtgttccagccctgcaccgcctgcatcagttccagcagctgctctgggtcctgggactgctggtgggcctcctgctcctgctgttgggcctgggggcctgctacacctggaggtgggtctggagctgggagtgggccagaagattggggtaaggcagcccacctcgtcttctccccaaattcccccaggtcctttaggacctcctattaagttcacaggctgcctacttcccagactgcccctccaaattggaaatcccttctagaattgtccctaaatcctccttgctgtagtttctttctttcctcctctctgccctggctgtgctaaagcaagggctagggaggaagacagaggaagcacccactctccatgaggttcccacgctcttgtggtctggagccagcctgtggggagcgggagaggaatgggggcaggaggtggggaggggagaggctctctgagtccactccgggccttgcagaaggaggcgtgtttgtaagcagagcatgggcgagaattcggtggagatggcttttcagaaagagaccacgcaggtatccattcaacacacacgggcagatataatacccagctaacccacagtgccaactggcatctggagactgctgtcatttagaggatggtgcctgggaccaaggggaggttggggagagtgtgcagggaaccaggagcccctcaggagataggagagccctgttctgctcggggcagagggaatccctgtgtcagctggcggctggcttagaggactaggggagactttctggacttggcagcatcccctccatttccaagacacgtatgttctgactcccccacctttgttctgaggcctcttccccactcccaagcctgcccgtcacctgggcagaagtgaaagtcagtttctcctcccctgtggtgtgtcccttctgcagctgattcacctggtaggccagggctccaagtcacacttccagccatgcacactcccaccaatcctcttgggaccccacctgaggctgggggcctgggggcctgccctggctcccagaggcctcctgtgaccagggttttctctgtgggaagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcccttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggccgggtgaactttgtgtagccgaggccgcaccctccctcattccaggctcattcattttcatgctccattgccagactcttgctgggagcccgtccagaatgtcctcccaataaaactccatcctatgaaaaacggaaagtgaatc

SEQ ID NO: 6936 - DNA, 910 bp, Homo sapiens
ttttgagacggagtctaactctgttgcccaggctggagcgcagtggcccaatctcggcccactgcaagctccacctcctgggttcacgccattctcctgcctcagcctcccgagtagctgggactacaggcacccgccaggcggatcacaaggtcaggagatcgagaccatcctggctaacatggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatgg

SEQ ID NO: 6937 - DNA, 3459 bp, Homo sapiens
catggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcggtacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacatcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaagttcctcttcctcgtctaaggaacatgatagaaaatgtcatccaaaccttaaaatttatgtatggttctttagatagtgccttttgccagattgagaatgttcctcgtttggatcatttttttaacttgttctttcaaagagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgtccgaggattactatgacatgaggcggctgtatacaattttggggtcttctctattttacaagggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgattaaaatgtgaaagaagggattgttaacttattgctattttggtatataatgttaatttattgactagtttgaaataatgtgaagtgttttttatatcagattaatataggaaatgtttattcttgaaaaatactcaatttgttgttgtttatttttctcaaaattcatactgatatctgatgaaatgattatgaaattgggagcaggtgaccaggtgctgtaactaagtagtgctatgaccatgagcaagtttttgtacctctctaagctcagagttttcatgtaaaatgagatgattgcattgaggtttcaaaaatacctcttaagtaaaatgtgcttttattttatttta

SEQ ID NO: 6938 - DNA, 1120 bp, Homo sapiens
  misc_feature (10)..(10): n is a, c, g, or t
  misc_feature (26)..(26): n is a, c, g, or t
cctggccganagctccaccgctgagnccaacgaggccaattttttatttgccaaaaaaagctaccatatatttaatgttttaataaaaattaaacattagaaagtaaagagcaataaaatacttaataactattgtgcctataatgctagtgctattgcctttattataataactagatttgctatttaaaaactgagtggtatcataatacatattgataaaataggattattacactctagagcaataaaaactaattgacctaaggcatatattatttatttagaaataaatctagctgctttctccctagtatagatttagattcatggattttaaatttactactgatgctttcagaaacaaaaattaaattaattggatggttagagtttttgttgtttgttgttttaatttctgaaatgagtgtgttcttttcttctgcaggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgattaaaatgtgaaagaagggattgttaacttattgctattttggtatataatgttaatttattgactagtttgaaataatgtgaagtgttttttatatcagattaatataggaaatgtttattcttgaaaaatactcaatttgttgttgtttatttttctcaaaattcatactgatatctgatgaaatgattatgaaattgggagcaggtgaccaggtgctgtaactaagtagtgctatgaccatgagcaagtttttgtacctctctaagctcagagttttcatgtaaaatgagatgattgcattgaggtttcaaaaatacctcttaagtaaaatgtgcttttattttatttta

SEQ ID NO: 6939 - DNA, 666 bp, Homo sapiens
  misc_feature (10)..(10): n is a, c, g, or t
  misc_feature (26)..(26): n is a, c, g, or t
  misc_feature (624)..(624): n is a, c, g, or t
  misc_feature (629)..(629): n is a, c, g, or t
cctggccganagctccaccgctgagnccaacgaggccaattttttatttgccaaaaaaagctaccatatatttaatgttttaataaaaattaaacattagaaagtaaagagcaataaaatacttaataactattgtgcctataatgctagtgctattgcctttattataataactagatttgctatttaaaaactgagtggtatcataatacatattgataaaataggattattacactctagagcaataaaaactaattgacctaaggcatatattatttatttagaaataaatctagctgctttctccctagtatagatttagattcatggattttaaatttactactgatgctttcagaaacaaaaattaaattaattggatggttagagtttttgttgtttgttgttttaatttctgaaatgagtgtgttcttttcttctgcaggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacacgtcgttaactgtaagtnggtgntgttggtgtgcggcgcggccgcgtgttgtgggggggg

SEQ ID NO: 6940 - DNA, 667 bp, Homo sapiens
  misc_feature (10)..(10): n is a, c, g, or t
  misc_feature (26)..(26): n is a, c, g, or t
cctggccganagctccaccgctgagnccaacgaggccaattttttatttgccaaaaaaagctaccatatatttaatgttttaataaaaattaaacattagaaagtaaagagcaataaaatacttaataactattgtgcctataatgctagtgctattgcctttattataataactagatttgctatttaaaaactgagtggtatcataatacatattgataaaataggattattacactctagagcaataaaaactaattgacctaaggcatatattatttatttagaaataaatctagctgctttctccctagtatagatttagattcatggattttaaatttactactgatgctttcagaaacaaaaattaaattaattggatggttagagtttttgttgtttgttgttttaatttctgaaatgagtgtgttcttttcttctgcaggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacacgttgtgacgttaaagtgtgggtgggtttgtgtgtatggtggatatggtggggcggggcat

SEQ ID NO: 6941 - DNA, 684 bp, Homo sapiens
  misc_feature (10)..(10): n is a, c, g, or t
  misc_feature (26)..(26): n is a, c, g, or t
cctggccganagctccaccgctgagnccaacgaggccaattttttatttgccaaaaaaagctaccatatatttaatgttttaataaaaattaaacattagaaagtaaagagcaataaaatacttaataactattgtgcctataatgctagtgctattgcctttattataataactagatttgctatttaaaaactgagtggtatcataatacatattgataaaataggattattacactctagagcaataaaaactaattgacctaaggcatatattatttatttagaaataaatctagctgctttctccctagtatagatttagattcatggattttaaatttactactgatgctttcagaaacaaaaattaaattaattggatggttagagtttttgttgtttgttgttttaatttctgaaatgagtgtgttcttttcttctgcaggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttcaaaaagtttataatgtctgggcattggctt

SEQ ID NO: 6942 - DNA, 3396 bp, Homo sapiens
catggcggccttagcaagctatagctgcgagatttgaattactccactcgtagctattgcattcctgacgatggcctctgtggcttcgtgcgattcgcgtccgagctcagacgagctccctggagacccctcttcacaagaagaagatgaggactatgattttgaagatcgggtcagcgactcgggttcatattcctcagcgagtagcgattatgatgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcggtacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtgatgtccttgttgctgtgaatgatgtcgatgttactactgaaaacatcgagagagttctgtcttgcattcctggacctatgcaggtgaaactgacatttgaaaatgcatatgatgtgaaaagggagacatcccatccaagacagaaaaagacacagtccaacacaagtgatttagtcaagcttctctggggagaagaggttgaaggtatccagcagagtggcctaaacactcctcatatcattatgtatctcacactacagctcgactcagaaacctcaaaggaagagcaggaaattctttatcattatccaatgtctgaagcatctcagaaacttaaaagtgtgagagggatttttctcacactctgtgacatgctggaaaacgtaactgggacacaagttactagttcatccctccttttaaatggaaaacaaattcatgtggcttattggaaagaatctgacaagttgttgctaattggcctgcctgctgaagaagttcctcttcctcgtctaaggaacatgatagaaaatgtcatccaaaccttaaaatttatgtatggttctttagatagtgccttttgccagattgagaatgttcctcgtttggatcatttttttaacttgttctttcaaagagcacttcagcctgcgaaactgcattccagcgccagtcccagtgctcagcagtacgatgcttccagtgcagtacttttagacaacctccctggagtccggtggctcacacttccactggaaatcaagatggaattagacatggcattaagtgacttggaggctgcagattttgcagaactgggttatttgatatgcagtcatttgcccaaggatgatcttattgatattgccgtatactgtcgccactattgcctgctgcctttagcagcaaaacaaagaattggtcagttgatcatatggagagaagtgtttcctcagcatcacctccgacctttggcagactcaagcactgaagtctttccggaacctgaaggaagatattttttgctagttgttggcttgaaacattatatgctatgtgtactattagaagctggaggttgcgcatccaaagctattgggagtcctggaccagactgtgtatatgtggatcaagtcaaaacaactcttcaccagctggatggagtagattctcgcatagatgaacggctagcatcttctccagtcccctgtttgtcttgtgctgactggttccttactggatcacgtgaaaaaacagatagcttgaccacttcgcctattctcagtaggctacaaggtacttccaaagtagcaacttctccaacatgcagaagaacgctttttggtgactattccttaaagacacgcaagcctagtccttcctgtagtagtggaggatctgacaatggttgtgaaggtggagaagatgatggctttagcccccatactacaccggatgcagtacggaagcaaagagaatctcagggctctgatggtttagaagaaagtgggaccttgcttaaggtcactaaaaagaagtctactcttccaaatccatttcatttgggaaacttgaaaaaggaccttccagaaaaagaattagaaatatataacacagtgaaactgacatctggtcctgagaacacacttttccactacgttgccttagaaacagtgcaaggaatctttattactcctacccttgaagaggtggcacagctaagtggctctatccaccctcagctaataaagaatttccatcagtgttgtctttccattcgtgcagttttccaacagacattggtggaagagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggagactttttcttcatccaaaacctcaagaactttatgtctgttttcatgactcagtcacagaaattgccattgaaatagcttttaaattgttctttgggttaaccttgtagctgtgctttcttgatgcgtagaaacacgtgcatggaggatcaaacactgtcagaattgctgaaatcaatacacaaagagataaagtttagcttctttttactattcaatattgaacataatattgttaaatattgagatgaaatgctgttggatttgatacattaaatcttaatgtaatattgtaagacttttgagaatatacttgattaaaatgtgaaagaagggattgttaacttattgctattttggtatataatgttaatttattgactagtttgaaataatgtgaagtgttttttatatcagattaatataggaaatgtttattcttgaaaaatactcaatttgttgttgtttatttttctcaaaattcatactgatatctgatgaaatgattatgaaattgggagcaggtgaccaggtgctgtaactaagtagtgctatgaccatgagcaagtttttgtacctctctaagctcagagttttcatgtaaaatgagatgattgcattgaggtttcaaaaatacctcttaagtaaaatgtgcttttattttatttta

SEQ ID NO: 6943 - DNA, 309 bp, Homo sapiens
tcctactgcttactggcttgagagagtaacttcgccttatgggcctcagttttctcatctgtaaaatgaagttaaaaagcacattcttcctcatagggcagtggtgaggactaaaggaggcgatgagaagagagtccccacaaggagtctggcacagaggaagtttcgacgtatgctgtccattgcaacttcgacttatgctgcgtttctgtgtcggaacagtggaagacattcaacaagcactttgtctcagaggcttagttacaattaattgagcctgaaagaccatagacttgaaaaagccctcaa

SEQ ID NO: 6944 - DNA, 444 bp, Homo sapiens
aaaaaagagaacgctggcattatgatcaggaaaacccattgtcatcgccgaccctccctcccgtcccaccacacgctgctgtcacgacgtaggtgcgaaagacctttttgtacagagatatattttttatgaagaatttgtaaaattattaaatatgctgtaattttttgattaatgtaggtacattgttaaaaaataaatgtttttacaatacagaactgtaattttcccaataatgtaaaatgtaccatctctagctgattttcagttccaatcctattacacatgtattaatattaaagtggcctgttaaaatgaacagtatcttttttttgtcaaaaaaattataaagagggtgtaatatagcctgtgcaatgccaccaatctttaaagcaaatcagagttctaattaaatatttaattttagatttctatttttctgtg

SEQ ID NO: 6945 - DNA, 695 bp, Homo sapiens
  misc_feature (28)..(28): n is a, c, g, or t
gcctactactactaaattcgcggccgcntcgacttttttttttttctattctaatctattaacttttggttattttggattaagctacaaattctaattacatcaaccaacagaaatgacatattatgcctttcaggactttgccaaatgatttatttcatgcagttcaaattgaatgtcactgtcttacatttatcacagtgcatcttgcattgtgcaattttaccctagaaatgcacttagcacctagagatgcattgtgagatttcaacttcagaggttcacaatacccagggcatttacaagctattcccaaagacggattacgcagtggatggaggatgcaaatgtggatggaggatgaagcagaggaacaaaacgagtctttgagggcttagagatgaaaaactatagctgttagtgaataagtaaagttctgtgtatgaattgcaagtatttgctgattttaaacaaagtatgccatattcctttaaactagattcaaaatgttaagtatactaatatgttattcaaacagtaaacctcccatcccctatgaaagttgacgatcgagcgctccagggtatgaattctctcagtgacttacatgttgaaaagtatccagggccaggtgggaggccacaggacctcaccgataatgttggtcgacgcggccgcgaatttagtagtagtag

SEQ ID NO: 6946 - DNA, 460 bp, Homo sapiens
acctaaagcccattccaaaacagacatacttccccatgatttccatgtgatgctaagtgcatttgttctaatctgttgtttcgttgagagtacagttcttcaggaatcttatctttatgcatgatatatgtgtacttgtttctccttactagtccccaaggcttcagacaccttggtcaccaagactggcacaaatctgccccaggtcatctccagcttccattgatgcttagcattccgactttttctttctttctgcttctttttcttctttctctctctgtgtgtgtgtgtgtatggtggggttgaggggaatcaaggaatttactttattgctttcccagttattataaaaggatgttcattacttctaactagcatttccaagtttttgtcataaatgggaggcccttcacattaatttgtgtaccttgatgccaaaaacagaagtcattacatt

SEQ ID NO: 6947 - DNA, 812 bp, Homo sapiens
tgaaattatgcacacataactggccaaatatcagataagtgaactgttaatatatgagagaattttctggacttttaagttattaatctcaattatttgtgtggtgagtactaaattattttctgtttgtgttgatctgtccatttctgtatatagttgtccctcagtatattgagggattgattccaggtcaaccccgtcctcttcagataccaaaatccacagatactcaagtcccttatataaaatggtgtagtgtttgcatatatcctacacacattctcttgatactttaaatcatctctaaattacctgatacgtaatacaatgtaaatgctatgtaaatagttgttatactgtattgtttagggaataataatgataagacaaaaagtctatacctgttcggtacagatgcaaccattctgcctcctccctaccccctcccaaatatttttcatcctggttgaattcacaaatcctacatggttacggagggttgactgtatttgcatatgttgttaaagtggtgtttaaaatgtgcaatctgtactacaattctaaattttggattgatttgaactaggatctttgcaaataaatctcatagacattaatgtttgtaagaaatttttaattaaatgatggaaggaacatagaatggctacctgtgattttgattagtgtttaacagattgccacagctgtgattgaattccttttgtactggatgagcatggtcatttgggattactgatggtgaagtctagctggtgttaagagaataaatattgctgatgctaaacctggtt

SEQ ID NO: 6948 - DNA, 400 bp, Homo sapiens
gtgtccctcgcattatcttgaggacgtgcctaggctgttctgctgtcctggatggagcatttgagatgcatgatgaaggactgagttaaaccagctgcccagcatagataagctgagtagaataacttaatttttttcattaagtttattttccaattaacaaaaagaacatctgtagcaatgcttttggctttgttagctgtagcaaacttgctggtttatgcaaaagtgtaaaagtgtgacacacatagatccagctaaacaataagaagaaactggtatttatatacacaagtatatttatatacataaaccatcacattgagtagtttgatctcttttccctacaggaagacatataatcagctttctttgttctgatacaaccattcaaaaaaga

SEQ ID NO: 6949 - DNA, 565 bp, Homo sapiens
ttctttttcttttttttttttttttttttgagacagagtcttgctctgttgctaggctggattgcagtgacgcaatctcggctcactgcaacctccgcctcctgggttcaagtgattctcctgcctcagcctcccgagtagctgggactacaggcatacgccaccacgcctagctaatttttgtatttttagtacagacggggtttcaccatgttggccaggatggtcttaatctcttgacctcatgatccgcctgcctctgcctcccaaagtgctgggattacaggtgtgagccatcgtgcctggccccatccaacattttctaaagtgcctaatcttactgaaaaaggtgacattgaatatacagaaaacatgctggaatcaggcacttgaaagagaaattgattgatttttttaatctagcatttttaagaaatgaacattcttgctatagaaatgacttgatttaaatcactaatcagaaaggttcaacttagtctatgcattgcattattcgatgtactctaaattccttttacaactcagaaatgttgtctatggatgt

SEQ ID NO: 6950 - DNA, 440 bp, Homo sapiens
gattatagcacctttatgttcaatatcatctatagaaactcaactgttggatgcattagcatcagaatgacagcttgtagtacactcatttgtgttcacagatctcagaaatttttatgtcctaaatggagggacttttaaaaataatgatggagctgggcatggtggcacacacctgtaatcccagcactttgggaggccgaggcgggcagatcacctgaggtcaggagtttgagatcagcctgactaacatggtgaaaccccatctctacaaatacaaaaaattaggtgtggtggcgggcgcctgtaatctcagctgctttggaggctgaggcaggagaatcacttgaacccgagaggcagaggttgcagtgagctgacatcatgccattgcacttcagcctgggcaacaagagtgaaaccccatctcagaaaaaaac

SEQ ID NO: 6951 - DNA, 490 bp, Homo sapiens
gcaatggaggcagcagagggttcactttttgttctggtttatattaaattaggaaagctagatttgctaattgtcatatgactttgattacctctccaacatttgctttttaccatgtttaaaatccttttattggtgatttgtttttggacacagtatactctgtccaagcttcaaatgaaagcactgctctttaagctcctagcatcttaccttaagttctgttggaactgggtgagacctcatgtttgcgtatgcggtctcactgagttttagtaagactcagtttttaagcttcagcaactaatatttggaattgcactttttaaattatagaatatgatttgtgtccttgaagtttgatcattacctgaagaattggctgaaaacaataaatgtttaaatgttgcaatttagagaatgtctttattgtgttgccaaatgctgaatgacagagagctttaattctaactgctttaattagaaagag

SEQ ID NO: 6952 - DNA, 411 bp, Homo sapiens
tcgaaataccaatatttatattattaccaatatggaactacagaggaaagtttaatacttctttgtaatttttgttttgttcttaaaatgcattccactaagggtatgtattaaaaatactgtgttctaaaattcctaaaaataaattcttcctcagagagcatgtcacccagtttgatgtatggttaggctcatatcattcagtttcttttcagtttaggacattttgaatggagcttttttaagatgggtaatgcattacgtggctgaagggtcaaaactatgtagatgtgggccgggtgcggtggctcacgcctgtaatcccagcactttgggaggccgaggtgggcggatgatgaggtcaggagattgagaccatcctggctaacatggtgaaacaccgtctctact

SEQ ID NO: 6953 - DNA, 278 bp, Homo sapiens
aacgacgctccgtaacgtccgtaacagcgccaaggtttattttatttgttgccaatatgtctcctgcaccagaatacgggcatcctaggggcatggacctagtcttgtacgtgcctggcatgtggtaggcactcattaaatacatatttatgccaggcatggtggttcacgcctataatcccaacactttgggaggctgaggcaggcggatcacctgaggtcaggagctcgagcccaggctggccaacatggtgaaaccccgtctctgttaaagatac

SEQ ID NO: 6954 - DNA, 404 bp, Homo sapiens
tttgctatgccacctcatttccacgtgagaaggaagtgcacgttcagggtggttggtcagagttaagtcagcctgtatccgtggggtgaaattaacagacatgtgggaattgaaccttaaacattctcagtttcactaggaacctaaaattataatcacgccacagagattgtaaatttgaaatttaccttgtttccatggaaattttgaattcaaaacatttaatgtgtaaaatatcactagtaagagggcacatagcattgggagatatacctaatgctagatgacacgttagtgggtgcagcgcaccagcatggcacatgtatacatatgtaactaacctgcacaatgtgcacatgtaccctaaaacttaaagtataataaaaaaaaaaaacattattcca

SEQ ID NO: 6955 - DNA, 695 bp, Homo sapiens
tttaagaggcagatcttgctcttccgtggcagtccagcacctgctgcctcgccctactgcggcccactttggggccgcagggcttacccgctcctttccgtgcatcatactttgttttctgttgaatactttcctcttagatcaccaccctgagatggtagaaaacataaaaatccctgtgtacacgtggagggagaccctctgggcctgtggagcccaaatatgaatctaaggcaatgggtggattctggattaactgcgtttcacgctgggaagtgactgcggggagtttgggtcctgtgtggtggtgaccgacgattctgtcctagatcccagtggagaacaccaaagcgagcgaggaggaggaggacccgaccttctgtgaggtgtgcggcaggagcgaccgtgaggacaggcttttgctctgcgacggctgcgatgcggggtaagggacggttgggactggcacacgtgccctgctgcgtgcaaggcgggccaggcgcaggagggatgcagagcctcttcgctctgtgaagtctgagtcccagcacctggagctgtgctcaccaccctcagcagcgcggttcagtcctgcgggccttcctgttacactcatttacacttcagtctttccccaaaaaacattctgaggctgcccacagaagtgcaggtaatacatcaagacaaaaaagaaa

SEQ ID NO: 6956 - DNA, 1101 bp, Homo sapiens
tttaagaggcagatcttgctcttccgtggcagtccagcacctgctgcctcgccctactgcggcccactttggggccgcagggcttacccgctcctttccgtgcatcatactttgttttctgttgaatactttcctcttagatcaccaccctgagatggtagaaaacataaaaatccctgtgtacacgtggagggagaccctctgggcctgtggagcccaaatatgaatctaaggcaatgggtggattctggattaactgcgtttcacgctgggaagtgactgcggggagtttgggtcctgtgtggtggtgaccgacgattctgtcctagatcccagtggagaacaccaaagcgagcgaggaggaggaggacccgaccttctgtgaggtgtgcggcaggagcgaccgtgaggacaggcttttgctctgcgacggctgcgatgcggggtaccacatggaatgcttggacccccctctccaggaggtgccggtggacgagtggttctgcccggaatgtgctgcgcctggtgttgtccttgccgctgatgcgggtcccgtgagtgaggaggaggtctccctgctcttggctgatgtggtgcccaccaccagcaggcttcggcctcgagcaggtaggacccgggcgatagccaggacacggcagagtgagagagtgagagcaaccgtgaaccggaaccggatctccacggccaggagggtccagcacacaccagggcgcctcgggtcttccctgctggatgaagccatcgaggctgtggcgactggcctgagcactgccgtgtatcagcgccccctgacgccgcgcactcccgcccgacggaagaggaagacaagtaagcctgaagggaaggactctcccgccagccacaggctgggacccacgcccgaggtccactcactgcttccctcaaggctgtgggcatttccatttcttctttctgcaagttaatcttctctgctgaaaacactacacagaagccgcgccgggcccgggaggtgtgggtctgatgtgccgatctgcgaccacgctgcctctggcattgtgtcagggtgatgccggccttcccgcattgttcccctctgct

SEQ ID NO: 6957 - DNA, 295 bp, Homo sapiens
aagaaagaaaaccccgtccggaccatccgcaaaaagtaagagctcagcgacaagatctaagaaacgccaacatcgagtgaagaagagaagagggaagaaggtaaaggtgagcattgggtggcagggcctgagtctcctgctggccacagcaccctcgcgtggttacggagcagggcctaagcctcccgctggccttggcaccctcgcgcggttatggagcagggatcatcatcgtctttgcttttctgtatttactcagtgatttgctgatggaaatgaacatttctgtagcaca

SEQ ID NO: 6958 - DNA, 1084 bp, Homo sapiens
  misc_feature (15)..(15): n is a, c, g, or t
  misc_feature (72)..(72): n is a, c, g, or t
  misc_feature (74)..(74): n is a, c, g, or t
  misc_feature (110)..(110): n is a, c, g, or t
agctgtaccgtccgnattccggatcgggtggggactttcgcgcggccggtgcctcggtcgtaccctgggcgngngcggctgcctcattagtattcgaacccacgaggcgngcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6959 - DNA, 1138 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6960 - DNA, 1033 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccgctttggaaagggatcctctaagtcacct

SEQ ID NO: 6961 - DNA, 1227 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgagtctggtgcacccccccattcccctgccttcacttgagggcaaacctccccctcctggccaggcttcagttctcctttcttccaggtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6962 - DNA, 1174 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggatgcctggctctgagccacccctgctttggcgcaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6963 - DNA, 982 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaagaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6964 - DNA, 1052 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccacgatggccttcattacttacgtgctcctggctgggatggcactgggcattcagaaaaggttctccccggaggtgctgggcctgtgtgcaagcacagctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6965 - DNA, 541 bp, Homo sapiens
ccccagctcaccctctgttgccccagtctctcttcctcacccctgcctcaggatgcctggctctgagccacccctgctttggcgcaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtgggaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6966 - DNA, 663 bp, Homo sapiens
  misc_feature (629)..(629): n is a, c, g, or t
  misc_feature (634)..(634): n is a, c, g, or t
  misc_feature (661)..(661): n is a, c, g, or t
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatgggaaggacatggtgcacaaggagctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccaaanccccnttccccctttaattattccccccaacnaa

SEQ ID NO: 6967 - DNA, 839 bp, Homo sapiens
gggacgggagaaaacttaggctaggtcgaggcctggtgttagacgccacggacatggtggccgagaccggcggggtgggggacgtgtcgcgcggccgggtggcctcggtcggtaccctgggcgcggagcagctgcctcattagtattcgtacccacgaggcggcgcagcgggccctcggggacagcgagcgtcgcggccatggcttatcactcgggctacggagcctgcaccgttttgtgtctgtgagcaaactcaagtatttttttgctgtggacacagcctacgtggccaagaagctagggctgctggtcttcccctacacacaccagaactgggaagtgcagtacagtcgtgatgctcctctgcccccccggcaagacctcaacgcccctgacctctatatccccagctgcccacacatacagctgactcttctctgtcctgttggctgcacagggccaggcccatcgtggacacccaggcgatggccttcattacttacgtgctcctggctgggatggcactgggcattcagaaaagaatgatcctcagtgtgctcacggggctgctgttcggcagcgatggctactacgtggcgctggcctggacctcatcggcgctcatgtacttcattgtgcgctctttgcggacagcagccctgggccccgacagcatggggggccccgtcccccggcagcgtctccagctctacctgactctgggagctgcagccttccagcccctcatcatatactggctgactttccacctggtccggtgaccccctggccccagatggcactgagtttttcattcattgaagatttgatttccttga

SEQ ID NO: 6968 - DNA, 251 bp, Homo sapiens
cggtggtttgggctcatgcttggtatttctgtcatctactctgatacctccaaacccacggctccaagcacagggcccgggcagccccggatccccctcccctcttcgatgacacaagcggtggttattccagccagcccgggggatacccagccacaggagcagacgtggccttcagtgtcaaccacttgcttggggacccaatggccaatgtggctatggcctatggcagctccatcgcatcccatggg

SEQ ID NO: 6969 - DNA, 510 bp, Homo sapiens
gcatctctctggcacttggcagcgatggccttcattacttacgtgctcctggctgggatggcactgggcattcagaaaaggtcagtgccaagcccctcccttaccctcccctccctgtgagctcttctcccaacctccctagggcatatgtggtggtccccagctcaccctctgttgccccagtctctcttcctcacccctgcctcaggatgcctggctctgagccacccctgctttggcgcaggttctccccggaggtgctgggcctgtgtgcaagcacagcgctggtgtgggtggtgatggaggtgctggccctgctcctgggcctctacctggccaccgtgcgcagtgacctgagcacctttcacctgctggcctacagtggctacaaatacgtggggtgagcacttgtgggccagggggaggtggccttggatctgggcctgcatagctgtagcctcgaactgtgaccctggacatgtctcggcccctagtgacctctagcactgc

SEQ ID NO: 6970 - DNA, 187 bp, Homo sapiens
ctaaagggccacattccacttgatcccttttattaacgaaattgtactttgcagcaaggtggggtgtggccacagagctctttaaagatgggagcctggaggcgggaggttggctaattgcatgttgccttttggcttctttccagtctttaatcatggatgacctcttatctgtaagttctaggcc

SEQ ID NO: 6971 - DNA, 593 bp, Homo sapiens
aatcactgcacccggcttctgtggcttttctgacatattccatgcctgactttgaaaaaactctcaggtgaaagtcttggttgtatgcagtagcaagcatgtactagattgataaatacaaaggggcttaccacaagatctctctctccatctctggatggagacaccatcagatctctctctccatctctgtctctaggtttgtctgcatactagcttaatttcttcttactcaagccttttctccataaggcgagatatgtggtcacaaaagctcctgtatttctcattacacacagttcctgtcatcacagagaatgattaacttggcctggttccagtttggaaaaatattcaagggaagaattctgattggccaatttaggccagatgttcatccctgagccaatcaactgaggccagaggggtggagtcatgtgagaacatggcagcccccatgagaggcacgtgactggagtaggaagtgtgagtctccatagaggggagagggctgctaggctgaaaaggcaaaagatgtctgcagtaaaaggaatagattaggagatatattctgttaaacctgttaattatta

SEQ ID NO: 6972 - DNA, 386 bp, Homo sapiens
ggttgcctttgctgaatgaacgttgagtggtcacagggccagaggctttgtctcttactgataccaaaggagttccccaacttgagtggcttctgatgccagtgcagaagagcattagtatttgagcagttgagaagtacattcagaggaaatttagagaaaaagattattgaaattatcccaattatgatgccaactaacatatgtatgtgattatttttaactaaagaagaaggataaagaactttgaaccagtatagtgtggtcctttgtctatttatttgcatattttgatttttaaataatgaacaaaaaggattcattcaaagcaaagctattttaaacttaccctgaaaagttaaaagtgattctttgggaaaagaagg

SEQ ID NO: 6973 - DNA, 477 bp, Homo sapiens
ggggaggccaaatctgttttctttctgtcttcccttgcctctctttctttgtcctctttccattattacctcctccttcctctcatctccaacgttaattcatttgataaatatttagtgagtgcttatgatgtgctaagtactgttctgacactaaggatacagcagcaagcaaaatgacgcccctgcattctagtgcagtgcatctcaagctttaatgtcatatgcatcatctgtgggtcctgccaaagagaagaattggactcagctttcaaataaaggtgatgctgatgccaccagtccacatcctctgggaagtaaggttctagactagaacactggttctcaagcttggttgcacataggaatctcctgggagttttacaaaatactaatgctgagtctcttccttataacattactgaatttaattgttctagaacacaggagaggatttttttaaactcccagggtgat

SEQ ID NO: 6974 - DNA, 1050 bp, Homo sapiens
acctgggcataaattaaataaacatatacaggatctgtatgctaaaaattgcaaaatactgataaaagaaatcaaagcaaacccaaagaagtggagacacataccgtgttcatgtactggaaggctcagcagagacgtgggttccctccagactgatgtacaggtttgatgtacttgctagcaaaaatcccagcaaggtatttttttgtagatgcgcaagattattctaaaatttgtatggaagggcagtgaaactaaaagtcacgaaaataatcttgaaaaagaaaaagaaaatgggcagaatcactgtatttgataacataccttgctatataactgcagtaatcaagacagtatagtgttggtgaagggacagacacaaggtcaatgaaacagaatagagaacccagacatagacccacacaagtaccaccagtggatttggacaaggtgcaaaagcaactcattggaggaaggcagcctatttagccaatgtgactggagcactggatacccataagccaaaaaaagaaaaaaaaaaaaaaggaccttgtctttggcctcacacttttgtaaaattaactcaaatggaaaatgaaattaactgtaaaacataaaactattacacttttgggaaaaaaatagaagatctttggtatctagggtcaggcaaagagttcttagacttcataccaaaagcataatctataaaaggaaaagttgataaattggaaacatttttaattcaacattttaaattcaaaattaaaaatgtcgctctattaggataaggaaaagacaacctactgccagggagaaaatacttgcaaacctcctgtctgacagagatcttatacctagaaaatataaagaatctcagaactcaacattaaaaacaatccagttagaaagtaggccaaagatagacattttaccaaagacattcagatggtaaataagtacatgaaaagttgttcaacataattaaccattagggaaatgcaaattaaaaccacagtgagatagcactacacacggattagagcagct

SEQ ID NO: 6975 - DNA, 490 bp, Homo sapiens
caaaaagaggtcacatgactagtttctacttgcacggaagctgggaaagaaagtttcagtttctactttgaagaggtgcatattagccacacagaaggataaatgtttcctttaatattccatgatgtacaacactctaaataggccttgccatcatgctgatattatgctttgaacatcgtaagttaataaggtctggggagcaagaagcattacaaaacacttagttgggaaatgcacatacacacacagaacaaaggaatgaatattcctatttagatatctggtaatcctttaagacctgtaagttcttccctaagagtagattcccaatagaaatctgattaaattcactccaatccctaaattctaaaaccctgctgtactactaccaccactgtcacgttcttatttttatatttgtagaaaagtcccaatgaatacctggccaaaacaacatcaaaaacaaaaacaacacacacaaacaaat

SEQ ID NO: 6976 - DNA, 270 bp, Homo sapiens
gggaattataattcaagatgagatttgggtggggacacagccaagccatatgaatcctccctttttccttcaacaatggatatcctggacaaataagttacactaggacagaaaaagaaagggacaccaacgattattccaataaatttttgaagtatacagttccaaatcaggtatttattttattgtaaaagatcaagaaaatgaaaataatccaagtcttttcatattttattctatacgtattatgttgtcaagtcatataacatt

SEQ ID NO: 6977 - DNA, 515 bp, Homo sapiens
accactcatgccacacatccccaaattgatcaacccagtccttgtgtgtgtgtgtgtcccccaaacacactgctggagctgagaaggagctgaccaggttagtttcgacaactcagtccttcattcagaaagatgaacaaccaaggatcatgatgggaaaaccaccagcacataagaggaaaggtcaggaagaacaaacagaatagtccctgaaggaagcagataaattagggaactggaagaaaattttctaaaaatctcatagtgtcctgcaagagttttgggaagatagtacatctgtaaactgttaataagaagtatgttctaggcttaaagtataataataataaaaaaagaagtatgttctaggaaatgaagcaatgaaaacaaagagtctgtagaaattagacacatgactgtcacaagattcggtacctgaagtagatgataaaatttcggagatcttatggagtttaaagcaaactatagagaggcaaaaaatataatagaaatgc

SEQ ID NO: 6978 - DNA, 453 bp, Homo sapiens
gacactaaacattctgacatctgttttcgacacattaccaggtttcagaattggcaaagagaaattatttcttaactgctcacccaccattatatatgctttccacccatatgttacccaccttcctccttaaaaaatttgatgatgttatttaataaatttctaaacctaagtcaccccagcctattttgagatgttttgataattattttcaggtgaaattttagaaacagttttgaaaaaggtgggaatagctggtaaggtctctttattatttatttatttattcatttattcaattctttttttttcttttcaccaaatagattttaggtaaaccaaggctttgaatagaacagaaaagtgtatgtatgtttgtacatgtgaactaattcgccaaattcgatgtatttttttctaccgaatctaaaattctattgaagagcttttttt

SEQ ID NO: 6979 - DNA, 451 bp, Homo sapiens
taacctgtagtaagttcagtaagtgttgaatcaatgaatgaatgggttccttggatgagggagaaagcccaaagctcagcgtgttgtagttatttgttacatttatatacaaggttgtccaggatgtataatccaggctttgttgagtggatgagggtatcctgactggggcctggcaaccccccgacatccacagaggaaaacaagtgtttgtgagagaagtgatagaatttgtcaaaagtatatgaaattagttacataaaatctgaaacatacattgtggttctgtttgtcctgtgactatgtaaaattgccattgaaaaaacccagaaagccgggcgtggtgactcatgcccgtaatcccagcactttgagaggctgaagcgggtggattgcttgcgcccaggagtttgagaccagtctgggcaatatagagaccctatctcaaaaa

SEQ ID NO: 6980 - DNA, 654 bp, Homo sapiens
ttcatctgacttaaattcttacactttgggctacaacttaaaaaaggctatgacttagtggaaattggcacttttaagtacaatatgaattaatagtataatttcgctgtcccccagagataatgctagtaccaatcgaaagctcagggatgctactgttgacgcatcagcaagagttcttgagcagttttacctgtccatcaatacaaagagttcccacaacagtagtgggattcctctgcctctctgaagatatgagagctataggagggattcccatgttggaggttagaagagctgacctccaatgtcccgtctaattccaagattctccaataatgactttggaacagctgtgtacagattatacttggaattatgcttagatactattgctgcaggaatgaatagacaaattttgttattaaaaaattgattttattaagtggaagttgacagaattatcctctttataatggaggaacattatgcttatgcatatgcatataccttatgcatatgattatgcttgtgcttccttctttaatggatttacctattcaaaagcttaataaatgttataagactctaaaacatttaaatctttcatttctcaattttatcaaataaacattcctggaatttgtgcatatt

SEQ ID NO: 6981 - DNA, 566 bp, Homo sapiens
ggaagggagaagggtaagacacaaagcagagattgaataaataggatttagcatcttactggatgtgagagtttagggcaagaaagtcattaaaagttgtataatgaaggttttaatggagagaaacatgacagacatgttgattttgagacaatgagaaaaccacctcttttttaaaatcttcagacacatacctgtggccactcatttcctaactgccaaccctacttcactcaatattatgacttgtacttttaggggacgtataagaatcttgaaaaaagaagaaaggattcaaactagggtttgctaactccagcctttcccactgcaccaagaaactaccatgtcacatcattatatatgatgtgtatatgggtattttgtttaggatttttttttgggataggggtcttgctttgctgcccgggctgggactccaaactccggggctcaagtgatccctcctgccttagcctcctgagttgctgggattacaggcaccagctgctgcacccagcttatatggtatttttatccaagaaatctagtcatcttacaaataa

SEQ ID NO: 6982 - DNA, 288 bp, Homo sapiens
  misc_feature (13)..(14): n is a, c, g, or t
ttgaggatccccnncttgtaatccaagcagtcgaactaaagactatttgctatatattagcattacggttagaagtctggaagcctttggaggctggcaaatctgagttcaggtctagctcttcgagtttactggctgtgtaaccttaggcaatttacttaacctccgtgagtctcagtttccttatctgtcaaatgaggataaaagaacttagagttgttattgagattaaacgggatgattcatgtaaaatggcttagaataacgactgcttggattacaaggatt

SEQ ID NO: 6983 - DNA, 844 bp, Homo sapiens
aagaggctgccctgcaaccctgggctggagtattgctgtggtcctggatttctggactttatttgcgttctcaagtggcgaagtgttcctcaacctggacccacatcagaagcaggttctccgagcccctaagcagcggcgtgacaaagtaattgtttaccctggaaatagactgttattttttaaaaattattgtcagggcttgctttaatgttcttaatgtttttgtatgagatcctccatgtgagatttgaaaagatccactatgcgggtcatctaaccggtcactagacattgattccacacttactacgtcgagcacagttgacactgggaatacatggatggacttatactagccctaaaataactccttttctattagaactttactaggtaaaggtatttgaatgtctgaactccatgtttagaaggagtcattggttttaaggctctgtcctagtacacctgtaagagcatttgcttaaaattgcctggcctttgtatgttatctctgtcacttcatatttgaaaatcacttgctagaatatggcctgatcaatgctgttatgctagtgagaaaatccacaactaaagactatttgctatatattagcattacggttagaagtctggaagcctttggaggctggcaaatctgagttcaggtctagctcttcgagtttactggctgtgtaaccttaggcaatttacttaacctccgtgagtctcagtttccttatctgtcaaatgaggataaaagaacttagagttgttattgagattaaacgggatgattcatgtaaaatggcttagaataacgactgcttggattacaaggatt

SEQ ID NO: 6984 - DNA, 262 bp, Homo sapiens
ttttttttggccaaaccgcagacaaagtgatcatcctcctgcaagaaagcacttgaatcatatgaaaaaggcagctgcatataattgtttctagaaatacacgaagcataaccaaatcattctaaacatcctccaaagagaggtatatgcaaccagctgtgaaagccaggagctgctggaacagccacaccagggtgtcggtgcatggccagagagactgaggtatgacaaagtctcactgccaaacaccaagccactcaaa

SEQ ID NO: 6985 - DNA, 469 bp, Homo sapiens
acatcttctatagcacatgagaggacctgggggagacccaggactgaggatcaagtctctcagtttcttttgcatcaatgcagtgatggaggcagaggcattaaaaaaacaaaacttactctggaccatgctcactgttaaatagaggcttaaggcaaaagctcttagatgtatgtgagtaatgatgagtaaaagatgcagctgcaactaattaggtaataccatatttagaagaaaagacttcgttttggagatatgcatgatacatagaaatatacttgacacccataatgtatcaagacaaaaatagatatacttttatcatagaactgcaagaaaatcactttatgcataaattctcaaagctttctctccctgtcactgcttagatttaatcaatgtatagactaattatgtttactccctcttaatcctgcctttgtctatgaccctgaaaaagaacaaaata

SEQ ID NO: 6986 - DNA, 312 bp, Homo sapiens
atatacataccatattacaagcttgatattcctctaggtcagaagttacaactttatttccatttcctcatgatctagcatagtgcccagtactgctcatttgagtgaaaataacttatgtgacactctacatttgtacatatatcttaaatgatgtccatgaaagccctatgtgttagatgaactacccattctgcaaaaaaatactattctggaagttttaaagttcatttttattggttgttcttttttgtgtgtgagcagcaaacatatttcttagtactgctacattaggtcaaagagtaaagagaa

SEQ ID NO: 6987 - DNA, 392 bp, Homo sapiens
aaaagagctccagggaattctgatgctcagacaggtctggaagttactgctctaaatcttattttgttgatttactggtatgttataatgaaattagtagtgagagtcttattagagtaatggtagtgctttgcagagttcttagaagacaaaaacaaaatgtaagttctgtcagtgaatataagaggttatcctagttctttaaacacaaacaaacaggcctttagctggattctatagcaacagtgaagaggcaaggggagacagctaatttctaagccactcaaggcctaaactactgaagcaatttatgagaaggcaatgcatattagctcaattattatcactcctccagggaatttaaatgaaccggtctcatgccttctttgttt

SEQ ID NO: 6988 - DNA, 665 bp, Homo sapiens
gcctcccagattcaagcgattctcctgtctcagccttccgagtagctgggattacaggcgtgcgtgccaccatgcccaactcattttgtatttttagtagagatggggtttctccatgttggtcaggctggtctcgaactcccaacctcaggtgatccacctgcctcagcctcccgaagtgctcggattacaggtgtgagccaccgtgcccacccccatcatcttcttataaggacactagttattggattcagggcacacactaaatccaatgtgattgcatctcaagatccttaactagttatagctccaaaaactctctttccaaatgaggtgacattctgaagttctggatgggcgtgaagtttgggagatgctacacagtggaagcacagaggagcagttaatttatagcaggtgctcatgaaaggtttcatgaaggaaggagcattcgactgagccttgaagaaggtcaagtgtttcaaccagaaggggtgtgacaagggaaatctaggtacaagaaaccacctgatcaaaagctctacctggctggaattgcgggagggaagaggaaagggaagcaagaaaacattgtattgtgggatagggaggtaagcagggagtttacacctcagactctgagtcaggtcagtactggtgagaat

SEQ ID NO: 6989 - DNA, 334 bp, Homo sapiens
ttgaatcaggtttcaagtactcttagcttttttctacgtcagagaatccaggtctctaagtctgacccagcttcttgtgcttgagccactagcaagccctaccagggaagacacaaatgaaacttactagctgcgtgaccttgagcaagttgctgaacctctctgtgcttcaacgtcctcatctataagttggggataacagtaccatttatgtcacagagttgtcatgaagctaaatgcacatatataattataatgtataatatgttatatatattacttgtataatattatacatgatataaatatatatattatataatgattcctggga

SEQ ID NO: 6990 - DNA, 865 bp, Homo sapiens
ctttactaagatctcttccacccctatctcatatatcgggtttatgggggccggtcgcatcgtagtttatgtaacaaattcaaagtgaaaatcatgtttacttttacttatacttatttgataaaaatatttttgaaacgatagtacttattttattatttgatatttcagttcctattcaattgtggcagattttctctgtttcacattttagattggcgttggtaatagaaatgtcagaatgttcaaattggccttcacgttgtcggagtgaacacattgacacctagctttaagactgatttatctgttggtgtactgaaggtttccatgtaggacttcaaatgtggaaaaggaaaagcagtcaggaaaatggggcattctttggagagtcacgcgttttgattcggacatttccgtagagctcggctcccagtgttgtgttcctcggtcgaaagggtctctgctgtttggggactcactggcctctcctagggactcctttgtcttgtgaaccccacgctgttggattctgtatcattatgctgaattctctgcacagttttccctggccaacctgcccacatccttggagatttgctttgccagtgggaatccttacattgctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatattgtacatatctaagtttgagtcattcaaactaggtgcaaaatgctgacttcagagtctgaattaacatctctg

SEQ ID NO: 6991 - DNA, 476 bp, Homo sapiens
attcattttttttttttaatttgggaagtgggacttgactaaaatgaaagacttaggctctgtgaaaggcactttaaagaaaataaaaagagccaggcatggtggctcatgcctataatctcaacactttggaaggctgaagtgggagaattgcttgaatccaggagtttgagaccagcctaggcaacatagcaggaccacgtctctacaaaaaattaaaaatttttgacattttaggaagaaggatcacttgagccctggaggttgaggctgcaaatagctatgatcacaccactgcactccagcctgggtgacagagtgagaatccatatcaacgaaaagaagagaacaggtcagacgcggtggctcacgcctgtaattccagcactttgggaggccgaggcgggtggatcacgaggtcaggagattgagaccatcctgcccaacaacatggtgaaaccccgtctctattaaaa

SEQ ID NO: 6992 - DNA, 396 bp, Homo sapiens
cctcctgatccgcccatctcggcctcccaaagtgctgggattacaggattgttctcaaatgcttttaactagtatcttgcctgcacatgtgttaatggtaaaaagccaggaatgttgtcttttttcaattccatgaattggatttagcagctgaattagatggtattcattataaatggcttcattagatttgaagctactaaacttacctatttgtataaaaatttatctcaatcatcatcataaccacaattaatttgaatcatttttgtgcacagccttttgccctaaagatattagacaaatctagaccttgctttatataagtacccaacagtgtttaatgacaattagcccacttgtgaagtaaaatgaaattttaaataaaacctttac

SEQ ID NO: 6993 - DNA, 839 bp, Homo sapiens
cagttatccttgtaactcctaatgtctatataaaagatttttatattttttaattcttaaaattttattatttatttcacaccaggccatcactgtgatacattttttaaaacacattaaattatcaccagaaaagtgctgtgatggaaaatataaattgaaataccttttctggttaggagagtaattctgtttttctgatagagaatagaagagtccttcaggcccctccaaactgtcatattccgggcatcgggtgtccccatcctcacttcagtccacaggcagggtcctcagtcttcagcgctccttctctttcccctttgtcttgtgtctccttgggtctcttttctccaagacctaaactccctgaggacaggactattttttacatcttgatgtcactcctgagcacttgctttaatgtgttggacactgggtccattaaagattgtatgtgaaattataaaagaaacgttttcacctttctgtggtacagctataatttctggtttcatttaccaactgggtgaaagtggaccagtgacaccatttgtctgggccttcctttcctgaaatataatattggggcaatagtccctggttcttgtaaggtgttcaggcacaaaacgctaggcatgtaacatactaaatgaggttttcccagttaatttatatgattgcaaaggacgttcatatacacggtctgctaaagaattctggggccaattaatctctgtggcatgatgggtaagtcgatcccttctctgggcgtctattacttcagaaaaggcatgaactcaattttagggaccacacaaaaaaatttattcactatc

SEQ ID NO: 6994 - DNA, 1248 bp, Homo sapiens
cccgatacatcgagctcgtaccaagtcatataagcgtaaagatacagtaaaataaactcatcatttttaatgtaggtttttcaaactttgacacacacagagctgtgtctgtaagcctcagcacaatcaggaaacagcctctggcaaccaccaatcccttttcttccctagatgtgccttgtccagaatgtcgtatcaacaggaccacaggcgtgcagccttttgagtccgactccacagcattctgcgtgagatgctgcatgtgtgagcggtttctcagatgtcaagtatagggtattctcacaaaatgttcttttctgcattttcaaagaaagagaagctcaaaatttctacactgctctgagagaagtggtatcagacctcactgcgacaaagtgcagggctatggagtgagacaagcacaacctgtggcgtcaggagcgaggcacctgaactccgccttcgccgatgatcagcaacggctggggatgagacgccggctctgcatgtgctggcctcctgagctgtcgtcagatccacagagacacagtgtctgaagtagctacccttttaatactgcctgtacctttctaactacagatagaaaagggtcatgtttataaggtacggcggtgctagtttttatttcacttgagtccatacaaaaagcaaaaagcgcctgttctataaaaacagcagaaatgatgctaaacagttaacaccagagaaagctaacgggaagaacgtgggcctggggtcccaccatccttgccacgcaaacatccaccagtgcctcatccacctcacactgttctgagcacacgaggctgcatgaccaccgtgaggatctctggaggtgggaacgatgctaactgtcctgttcttagtgcacgtaagactcacgctcccacacacggtattccttttcctgcacattatttgacgctatcctgaaaagaaaaccagcaagtgaaatcgaatctgtccgtagagggtgggaatcctgttcactctaagtcagcccttctcctctaatagaggttagctgtacttttagaatggcctaaattatttttctaagtaccaagaagttacatattcattcatgccaactattttaaatatttcattgcaagtaagtgatttttatcaggcaagtaatacgtaatgaacttcccctaaaaataacagcttcctaatagtgctttttctaagcagaaaataatgactgcaaaataatttttaaaa

SEQ ID NO: 6995 - DNA, 641 bp, Homo sapiens
tatataaatagcttatattgtatttctgttggacaatactgttccaacaccttacagggtacctgttacagaattaggtactcagaaatttattggaatttatgataaaactgttaaacaggatggactctaatagtattccactagaggcctccctgcaactactttttggtatgagatagtttcaactgtgtcatcttgatcactgtcccttggatatacttagctttgtcaacaactttctgaaaatgtccatctgcattcgaacacactagtcttaaaatttaagtataacacttaggaatatattgatatttgccaaaaaaccccagtatttcctccttaaatatattaaaacaatttacaccctgcagattttatgatgtgtgataatttggctttgacacttatcttccattattttgagggcaactgtgtacagaaccaactaagggagccaataaaattcgctaggagtggctgggaggctaggatgaccaaaggtcaaatacatttaagaaaactaagctttagtgtagcacctagatgtcttaggataatttatatttaatttcacattctatgctctaaagtgatacttgataactgtgaacatttcttaataaatgccattattatta

SEQ ID NO: 6996 - DNA, 2951 bp, Homo sapiens
  misc_feature (1)..(1): n is a, c, g, or t
  misc_feature (3)..(3): n is a, c, g, or t
ntntttttttctcctaggtaagatagagtacctttcttatgcatagtaggcccacagatacttgcagaattgagttttaactctttggtgtcagacttatatatgctttagctatttagggtgtagtatgtgcttaattgaagaaaaatgtaatcctaagtctaatacctggacaatagtaatgagaactaaattacttttgacattgaattcttagagctttaaccaaaactggcctcatttctgtaattaatcaggagtgatggtaggtcttcaggtactgtccttggcataggcatttgcatctgatagaaggtgatagcagtgggctaggggaggtcctcaaatgctggtgggaccccaaaccctgctggtgtctaggcgcttgacatcctcacaagaatgaattcaagtatgagttagaaaatagtgaaagtgtggagatttattgcaaagcaaaaagtacacactcaagaaaggggagtgtgggcatgcttgagagagtcacacaaggtggtttggggctgctacctttatggatttctttaaccaagggatggagtattcacggagattcctggaagaagctggagatttctcagaactatggtgctacccatttttacctcaaataacgatgttctggaactgtcatggcactggtgggtatatgattgaatatgtgaatgagcatagaataaggtcctaggagaaacctggatcaaatccagcaccatgttggacccagtttgtctttgccagcttggcccacaccctgtttttcagggtcttatcagccccaagcttctgcagctatttcagcagtttccttttgcttagtcatgtgaaactgctgcctagaattttttattctgctgcaaccatcctgcattattcttgtctaaaaaccatatagacagaccaagcaaatggattattatcctaatagccatgggaatgaagacaaggtagcaacatgcccccgacaaacttagttgttatagataggtcagaagagcctcaaccgatttatccaatcttgaggtgcaaaaggtgttattctgtgttgatcttgctttctaaaacatgcaatgccgctcacagctcaaagtctcttaaatcccttcctctttttctcccatctttgcgtgagtgaatttttttttttcacatcatagtaaagtgaattctttaacctctttaaccaaaatgtcattggaatcttctggttttataataatattcattattatattctggcatgcctgtgcagatagggttttgttcagtgaataattccttttgagccacatatggcagagagagtaccataccaggtaccaggataccaggaaggaggaccaaagaagagtctttgccttcgagaagattgtttttaaagcttttcatcttttttagtaagttgggattccattcatctgcctaagaaggatgaaaggattatctttgtttttattggcaggaatgaggggtgaagtaggggagttcaacatctattttttgcaaataaagtaatatgctttagagtagccagatcctttgggctttgatcactgttagagcatagccaagcgtactaacgcaatatggaaccagatgctagaaagacatttaaaaggccatgtatcttaagtagtttatgtagcaggatttttccccctctacctcttgagccaataaatccattctatctaatttgaccaccactaattaattagttcagatgtaaattaaaggaagttattatttggctgttgaaagatttttatgtatgactacatcattttctcatgttttgatgaatatttagaatcccaatcttatattttttttccttaaaaaatcttgctacaaatcttgtaatagctgaagtgcatgttttaggaaggcagggagcacctttagtttaatggtatgtgatggtggcaagaatgttaacccaaagctttgcttatggtgggggtgggattggggtctaagcctgatgtcactgagcaaacacatacatggcttcaatgtacatgatgacaaatgagtcttaattacatgaatacagatagtaagcttatactgtgcgtggtttgtgacatgcctgaaaacatgagtgtattgagtagatgaagactaaatcattaacagtcaaccattgtgctccttgaattcttttttccttaaaaaacaattttttaaggggattaacacatctggttttgtgttgaaatatctcttaacgaaaatttatggtcttgaaataaagaccagggtgagaaaaaggagtcatctattttttcttattggctaatttattaatagccccatggaaggacatatgaccatcttacctaaattgatgttttcttagttgtgtggcagtgtatatttttgagccccgagactaccaaacagaaaaaaatacatttggaagtaaaaaccaccctttggatatttatattagttcagagtcttctttgcaagaagcagaaactgactctaacacatagaggaaagggttgatcgaaaagatgttgagaaaagcacagacttgacaaggagcctggagaaccaggcttggaaaatgggcaggcattcctaaaatgtggctatactctggctctgcctttgaagctgcgccaccagaaataccatttggggttctggtcatgctttttcttctcttccaaatgacatggaccatagctagcaatctgctggctcataaaactcttatctactggttaaggacctcaaccagtccccacttcagatttctaaacactacgcttcatctcattaccaaggggaaccttgaagtcttcaacctagctcttgctctcaactttttcttagtctttttactttttccattatattctttgatatatttgagaaaatggcttgcttttaaaaagtgtctccaaaggtttggcaaa

SEQ ID NO: 6997 - DNA, 431 bp, Homo sapiens
gggaagatattgcttctgtgcatttcacactatagagagaaacttgcctcattgtgacccctaacctatgtagtaaatcctctaaaattaattttggttccttctgatctgtgcccccatgtgactccccccaagatttcattattagattttgacagccttttaaatttgtaaatgccacaaatttgtcactagagatgaatgggtaaaaagaaaattccttgcagtggaggatatgggtaaaatatttcaagtgacagatctgcatcaataatgttaatgtttatggggtgatgaaaaccatgtaagtcttaagccagaatcttttttcagctgagtcccagaaattttgaccacagaagccaaggcacattccgtttattccaacaagtgttttttcacatcctttccaactgtctgaaagacaattg

SEQ ID NO: 6998 - DNA, 735 bp, Homo sapiens
ggatacagtaacgtaaaaccgcagaactgatgggtcatacaactcatttttgaatttgtactcaaggcctctgctacaaaatcccttgttgtttaacttaaaaagcctagaagcccttaagagctagctgttcttgaattttatctgggttgccttatagtctgagagttgcttatcagatttcctctcccctacatctcgtcatatgtattttcactttcacaaaggtgagtgcagcattaatgaggcaaaagttaatcttttctttgccagcattaataagagaccctaaagagcagcaaaggcatgtccagtgaactcagtcttcagaaaacttaagctttaaaacttcagtaatgaatttagtgcgattttgggaagctaattttgggatgctgttaaaattttgctcttacttgtggattacaggacattgaattaagatgcccaggctgtgcacagtggctcatgcctgaaatcccagcactttgggaggccaaggtgggtgggtcacctgaggtcaggagttagagaccagctggctaatgtggtgacaccatatttctactaaaaataaaaaaaaaatcagctgggtgtggaggcatgcacctgtaatcccagctcctcgggaggctgaggcaggagaatcgcttgaacccaggaggcggaggttgcagtgagctgagatcacgctactgcactccaacctgggcgagtgtgaaactccgtttcggc

SEQ ID NO: 6999 - DNA, 278 bp, Homo sapiens
ttcactattagaggctgttagcactcagacttcatcctgaacctggattagtgatcggttttgttttaagatcctaagagcacaaacaatgagacagaaacaggctccattcgctaatgcactgctcattgaggaatgtcagtgatgacatacatgtggaaaatttggggctaccagacctctccccagtctcatctcagtctcaggcccagaatgaggtgaaaattggagagagggccctggagcagagaaagggggattcctgggacatgtagggc

SEQ ID NO: 7000 - DNA, 462 bp, Homo sapiens
tcatgtctggaatgcataaatgtggatgatgacatgtttgagatgaacaagcacctcacgtacttgagaagcatcatcactttgggggaacttttccctgcagacccggggtgtaagagtagccagaccagtgccctcaggactggacttttctcctggttctcataccagagaaaactaattgttgggtgtgaatgcattgccttgggggttgtgactgggtacagccatcttagaaagcaaagcggtcatatgaataaaaagtcataaggatggattcccactctggaaagttcatcgaaataaaaaatacatacacataaaggagttcatcccaatgacataaatgcaaagagaatttttttggggaagaaattccttgatgtgatgtgtaagaatagactctgggctttcctcagctcctaagtgttggaaaaattgcctacatgagaaaaagaaaaa

SEQ ID NO: 7001 - DNA, 204 bp, Homo sapiens
aggctggagtgcagtggcatgatcatagctcgctgcagcctcggacccctgggcttaagcgatcctcttacctcagcctcccaagtagctggaattacaggtgcatctcaccacgcccagctgatttatttattttttgtagagacagggtcttgctatgttgcccagggtggcctcaaactcctggcttcaagtgatcctccc

SEQ ID NO: 7002 - DNA, 408 bp, Homo sapiens
ttttttttggctttttttttgtgagacagtctcaccctgtcgcccaggctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgagg

SEQ ID NO: 7003 - DNA, 259 bp, Homo sapiens
ggtcgactggagagaaggcagccaggagcatctgcttcctgattaatggagagtgacatcaccgccgcatgcaccctgactttaaaagcatgtgtagttaagggacttcagcttttcctaaagagtattcctcaagggagtaaggaaaaaaccaaactcaaccactaaagtgttcttccctaaatgtcaaagaaatctggtgggttgctgatgttgtttttctaaacctctttgccctaacaacactttgtaacataca

SEQ ID NO: 7004 - DNA, 411 bp, Homo sapiens
ttttttttttgtataattttgtattccctacagataatcactgccttagctttatctttttttaggttgcttaattttctatctacctacaataatttattcccaaactgtctatagaattataaatctgcaaacatctctggtctactatagtatccttcccatcctctgtatcattgtgggtttatgggggtttttattcctcattggcattttagtgacatttcaatgaggacagatgaacacacgtgctcaatcaatcatatttaaccaggagctagagatgttcattcgtttgtttgtttgtttaagaaatggtctcactatgtagtccaggctggtctcaaaatgctgggctaaagtgatcctcctgcctcaggctcccaaaaagctagggctacaggtgtgcac

SEQ ID NO: 7005 - DNA, 431 bp, Homo sapiens
aaaatttggtactatttaaatgtctcaagaaagccacagagtcacaccaggctaaccctgcgaacacagtagaaaccaaccagcataaatcacagaaagaaagtacacattaaaaaaaaagatcagtgagctgtagaacaacttttagtagcataacttacatgttactggaatacccaaaggagaataaacagaacaaaagcttaaaaagccccagaaaattgaagaaataatagtagaaaaaatacaaaattgatgaaaacaataaacccacagttttaagaatctcaaataacctcaagcacaagaaatgtgaagaaaactatacgaatgcagttcactttcaaaccacttatcactaaaaaaccaaagataagtagaaaatattaaaaaaaaaaaccaggatttttttaaggatgtcttatgcgcta

SEQ ID NO: 7006 - DNA, 141 bp, Homo sapiens
aatgagctccaccagtgtccatacctttggtctccctcaggaaatactcaagttgggttttcataatttggaaagacagggagaattgctttacagaacaaggctagttttgagatgtcattctcccctgccaaaaaaaag

SEQ ID NO: 7007 - DNA, 483 bp, Homo sapiens
gttaacagtgataattccattctaagactttattcatcttctaaaataaaaatgaagatttatatcatgaacttagctgtgatttgtattccagtttaatgggctttaccctaatcactagtgtgattttgtgtctatgaaaaacaaagtattgaaagttagtgttcctgtacaaagagtaatatcacatttgcaacatttagaacctttgtatgtgtggattaataatatcttacatttgatacagttctatatattattttcatggaaactaagtagatatggccggtggtgttttactcatttggcagttaaactttagctgctaaagaaacaagaaacagcctgggcagagtggcttatgcctgtaatcctagcactttggggggccgaggtgggaggatcacttgagcccgtgaggtgaagaccagtctgggcaacataatgagaccttgtctcaattattaaaaaaaaacaacaaca

SEQ ID NO: 7008 - DNA, 498 bp, Homo sapiens
ttgtcactggatccataactagggtcaaatcttagcatgttacagtgggacataaaactcagataactaactcagaaggaaatcacttacacaccaaaagaatggtaagattttgctaataaatattggaagaaacctgggaaacatgtcgagttgattctaagagtgttagatccaacagggtaggctatcacactccatttgtttaattcattgatatagatgcacttaccagagagtctggatttcatggtttagcttgagcagcaggaggtgactcaacatttgcctacatttgatgaggtggagatgtcagagcttccctgctatgatttgggggagagaatccaaagatgtagggagacaggaatgtcacagtggatttatcatgtgtgacttacacgtctaccaccaagcacccattcctaaccatgagaaggcccagaagacacttctttactaagacattgagaaatagaatagtgaggggagcatctg

SEQ ID NO: 7009 - DNA, 482 bp, Homo sapiens
ttgattaaccatatgcatatttgacattaaaataattcataattaggactaacagatttctggcttaaaaaatctaacaattactttaagaagcaaaagacatttccagaataaagtagggggatatatagaaaagttggtaccttttttaaacagagtcttcttttgtaaggaagtagaatttattcatcaaaggagatttatgaaaagtatggtggtatagtgagtggcctcactagttttaatgattgatatttgaatatagcttagtcttataacaactccccaaataaaaatttaaaattcatttgtatccctttgattttcagtgctaaaaactagattgtgaatgtcaaggaaatatttaagttatttctgaactaatgtatttgtagagagaagaagggagtgtgcacgtgatcgagaattatgttttgaaaataaatgaatgattggctattaaaaaaatttttaagccttaa

SEQ ID NO: 7010 - DNA, 2040 bp, Homo sapiens
aactgattcaggtagtttataatggtaatatactctcagatatcccaatatccaacactgattgcatgcacattatgataaacaattatttattcattaggcaaataaatattaatataatttctaatcttgaaaagcattattttaaaaataaaactattcataaacataagttgcatgtgaattatgaataaattataatttatttttgtaacccacaccttattttccaggaacataaatgtgtaagacaaaagcacagtatcagtggaatttctttccttttttaaaaattgatgcttaactttgtaaaactatatcccacattctgaatcctggagtaacttcagctctttagttggagaggctattaaaacattaagaaaagtaatgttgaaaggattctttaatgaaacccttagtgaatatgacagtgagtagtgaaaaataagtttattaagctacttcgcatcctagagtttcatgaaaccctatgaagttttaaataaaacatttatttactattaagtgtagttagtttttaaaatgttaatgaataaagaacttactctctcagtttatcttttacaatctttgaccagttaaaggggaaacaatttttacttaataaaatatttagaagtctgtagagtaggaatctttgaattggatgaaatttagtatttatctaattcatatactcaaacagccatcagatataagattcaggtcttactttctaaattatattattgtatgtatatatgaaatttcaaaaacaatttggtctctttccacttgagaatagtgcatgaagaaaataagtaattcaaatatatggatgtttagtccaaatttagaaatttccaccattttgtaaaattagttcattctacctgatgttaatatctcttttcttaaaaacttattcgagtatgtttttccttttatttttggtttatattataatacctatatacttatgaatctttgcaagtaaacacatagaatttaaactgaaaatgacaggagatagaaattgtactgtctatatattatgttagtgttttataaatagttgtgatgatgaagataatatgataataccagtgattcattagtctgaaaactagaaatgtcactttttcaggcatagcataagtcagatttagttgcagatttgtttggtatatgtaatttcatgtatacactgccctacattaatagaatggtactactatggtaaaaatattaaacatggtcatatttgaatttcaatctaatgactttttagaattcaactttatacagctaaatgcaaaactgaagatgattttaaagttggaacaattatagtttacatattatgctcatcatatgctcaccacaagaagagcatatagactcataattcagattttataatttcagcatagcagagtgagtatatgaattgatttggggatgacaaaaatccgattttgaatcccagcatatagcttaatattcaaccttctctatataattactctatatcagtttcaaatgggaaatataacagaatcttcctcataaggatttatagaaaaaaaatgagctgatgtatgtacagtctttaagatactagtataaatatatatatatatatatacaaacacatatgtaatataaatgtggttgtatgttgttaacttaattatccattaatgtgtagttttacaaacattattattacttctttttcttatgattttacaaccatgacatttcaacttttgatatgggcaactaacagtgacccatctgtcagtcagaagtcctcgtgggtccctctgtctgtctgctaaaagtcctcatgggtccgtctgtctgtgttctaaatgaagtacttcttttctggcctactgcaattttacaaattaccttgtagagattagatacatttgtcccctctagacagaggtaacacctgagtacagaccttaataaatggagtgtggtctgattgaatgaatatttccatgcaggcaaaaaaaaaaa

SEQ ID NO: 7011 - DNA, 422 bp, Homo sapiens
cacaggctggagtgcagtggcacaatctcagctcactgcaacctccgcttcctgggctcaagtgatcctcccacctcaacctcctggagtaactggggactacatgcacaagccaccatgcctggctaatttttgtattttttgtggagtcagcgtttcaccatgttggtgtctcaaactcctgagctcaagcgatcctcccaccttggcctcccaaagtgctgggattacaggcatgagccactgcacctggcatcttatcctccaaggctgtgctaggaggagcaaacacacatagtgatttctgtaaacagatttatttatttatttatttatttatttatttatttattgaaacaaggggtctccaggctggagtgcagtggcgcaatcatatttcactacagcctcaaactcctggg

SEQ ID NO: 7012 - DNA, 109 bp, Homo sapiens
tgatgtctgagttgttttaccattccttgtctgaactttgcatgttagttccccatatcaaattctattgaataaatgatattatgtggtttttacgatgggttgccaa

SEQ ID NO: 7013 - DNA, 500 bp, Homo sapiens
aaactccatgtaagtattaatcttctaaatgttatctttgttacaaatttttttccaattttattttttggctgttgaatttgtggtcctcaaactttagcgatgtatcagaatcatgtggaaagcttattgaaaactggattgctgggcaccacacccagttcctggttcagtaagatgggtggaaggcaagaatttgcatgtccaacaagttcccaggtgatgctgctgccactgctgctggtccagggaccatagtgtgggaatcactagtttttgccatataaaagtttaaaatttggccaggtgtgatggctcatgcctgaaatcccagcagtttgggaggcagaggcaggcagatcacttgagctcaggagttcgagaccagcctgggcaacatggcaaaacccctgtccctacaaaaaatacaaaaattagccaggtgaggtggtgcgtgcctgtaatcccagtaactcaggaggctgaggtgggagaattgc

SEQ ID NO: 7014 - DNA, 678 bp, Homo sapiens
  misc_feature (619)..(620): n is a, c, g, or t
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgggaaannaattcccctatagggaggcgattacaattcactggccggcggtttacccgcggactgg

SEQ ID NO: 7015 - DNA, 949 bp, Homo sapiens
gagttgagcacagagggacagaggcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtgtccctgtctggatccttccccagtgtggccagaaatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcaccttcaaccccttcacagcccccaacccagcctctgtcggaggcgaattctcagagtgagggttccctgtcacttgagagaaggtt

SEQ ID NO: 7016 - DNA, 751 bp, Homo sapiens
  misc_feature (9)..(9): n is a, c, g, or t
  misc_feature (60)..(60): n is a, c, g, or t
  misc_feature (692)..(693): n is a, c, g, or t
ttaacctcncctaaaggaaccaaaagctgaagctccaccgcgggtgcggccggctctagnccggccggatccccgggctgcaagatttcggcacgagcacggaacccccagaaatgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgggaaannaattcccctatagggaggcgattacaattcactggccggcggtttacccgcggactgg

SEQ ID NO: 7017 - DNA, 976 bp, Homo sapiens
gagagggtcccggttcaaaaccaccacttgctggttgaggagtcgtcagtaagtggctgcgcccccaccctgaggcttgtttctccatctgtacaatggaaatgatgaagatgcccacctgatagggtttttgtggcaaataacatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtgtccctgtctggatccttccccagtgtggccagaaatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcaccttcaaccccttcacagcccccaacccagcctctgtcggaggcgaattctcagagtgagggttccctgtcacttgagagaaggtt

SEQ ID NO: 7018 - DNA, 1698 bp, Homo sapiens
cttctttaggtcctctccatctgtcccaaggacatgagagctgatatctgtgttcatctaaaccggaaggtttttaatgaacatcctgcttttcgattggccagcgatgggtgtctgcgcgccttggcggtagagttccaaaccattcactgtgctcccggggacctcatttaccatgctggagaaagtgtggatgccctctgctttgtggtgtcaggatccttggaagtcatccaggatgatgaggtggtggctattttagggaagggtgatgtatttggagacatcttctggaaggaaaccacccttgcccatgcatgtgcgaacgtccgggcactgacgtactgtgacctacacatcatcaagcgggaagccttgctcaaagtcctggacttttatacagcttttgcaaactccttctcaaggaatctcactcttacttgcaatctgaggaaacggatcatctttcgtaagatcagtgatgtgaagaaagaggaggaggagcgcctccggcagaagaatgaggtgaccctcagcattcccgtggaccacccagtcagaaagctcttccagaagttcaagcagcagaaggagctgcggaatcagggctcaacacagggtgaccctgagaggaaccaactccaggtagagagccgctccttacagaatggagcctccatcaccggaaccagcgtggtgactgtgtcacagattactcccattcagacgtctctggcctatgtgaaaaccagtgaatcccttaagcagaacaaccgtgatgccatggaactcaagcccaacggcggtgctgaccaaaaatgtctcaaagtcaacagcccaataagaatgaagaatggaaatggaaaagggtggctgcgactcaagaataatatgggagcccatgaggagaaaaaggaagactggaataatgtcactaaagctgagtcaatggggctattgtctgaggaccccaagagcagtgattcagagaacagtgtgaccaaaaacccactaagaaaaacagattcttgtgacagtggaattacaaaaagtgaccttcgtttggataaggctggggaggcccgaagtccgctagagcacagtcccatccaggctgatgccaagcaccccttttatcccatccccgagcaggccttacagaccacactgcaggaagtcaaacacgaactcaaagaggacatccagctgctcagctgcagaatgactgccctagaaaagcaggtggcagaaattttaaaaatactgtcggaaaaaagcgtaccccaggcctcatctcccaaatcccaaatgccactccaagtacccccccagataccatgtcaggatatttttagtgtctcaaggcctgaatcacctgaatctgacaaagatgaaatccacttttaatatatatacatatatatttgttaatatattaaaacagtatatacatatgtgtgtatatacagtatatacatatatatattttcacttgctttcaagatgatgaccacacatggattttgatatgtaaatattgcatgtccagctggattctggcctgccaaagaagatgatgattaaaaacatagatattgcttgtatattatgcagttgactgcatgcacactttacatttatttataatctctattctataataaaagagtatgatttttgttacccaaggcaatgtaa

SEQ ID NO: 7019 - DNA, 759 bp, Homo sapiens
taggatatactggtactggcttttagttttagtaaatgttaagttggacaagttaggggcctagcttgggagctgcagaaattggctgagccccacaggtgatttatagataatctttccagtaagaacattgaagggctacacacaatgacacttagaaaaagaagggaaatgaagctgttccttgactactacccagtttctgttgaggtttattacttctagatgataaggtttacacgaagtttacattatgttttttcagttctcaagtttcagcaaatacctgaaccaagtttttttctgttattctaagaactgccctggagtgccttttaacttttgtactaccacgcaaagtgtactatcaattcatgtcctttagctcttctattcttcaatgcatttctcccattcctgtaggtatggcggggatcaacttttcataccaccaagagtcacccctattccctttgaagtactgccctatggcataagcttgttcatacggtgttcaaacagctaccgttcacttctatgagggtcaccttactggaaaccaaggtatgacgagtaactaaatcttctcatcaagcagaagggagctggactttagaaatggagcctgggccacgcagagtggtcacgcctgtaatcccaggactttgggaggccgaggtgggcagatcgcttgagcccaggagtttgagaccagcctgggcaacatggtgaaaccctgtttctacaaaaaaaatacaa

SEQ ID NO: 7020 - DNA, 591 bp, Homo sapiens
cttttcagttttcctagccacacttctcattggccaggaaaattaaatgcatgtcaacactgaagaaaacagatcttggttaaaagcaatgatgtagctaatatcccgttcaggtaaaagattacttatatagtgtgagacaggcatgaggcagagaagtgcttacaggttggtttctgctttgttagcagatttacttttagatcatatactactttgtttttactgttttattgagaaaaaataacaaatatttccaaaattttgcagcatgcaactcagtgcttcagttggcattcaatcaaaatttccttgaaataaaaaaagacaagagagagacttggaattatgactcttctactagattagctccttcatgtcaaaatctgtcaagtttatgatttattcagatagcacttgtttttggtgtaataactaaactgttgctttagagtctactacattctcctctattatttggcatttttctctttattattttgttcaagtaggatattgtgctgagttgaaccatgaaatgaattgtattgagcaacatcaacaacataaatattctggggtgtcatctgc

SEQ ID NO: 7021 - DNA, 1246 bp, Homo sapiens
gttaaagtttgatgttttcagactctaaagcctatgtttttgtaacttaattggactttcagagtgttaaattatggcttcagagtttggctctacctaaaatttagttagatgccaaccagggagaaattaaacctaatccttcaccccaaatatcagaggttagacaaacccatgttaattggagccttatggttattcatattggaggcaatagctttatttagaggaagcccaggacagggccgtctgggatgctagttctggaaatgcagaagcagccactgtatccctgcccaccccctccatccagcccttttggtactactcagtattgttgacaacatttggaatcataagtaacataggacagtaagtattagagaatgattctccgttagaattggacctcagccgatttgagccaaaatttaggaactattcagaagacagtttctttcttttgagtgcttaagacagtgtaaatggttcgaatcacacacattttaagattccattgtatacataagcattttaagaatattgttttaacataattattaggcatactaagttatcatgaatgaaaatgtacatgtgacctgtagtatgttatatattattatggctaaatgttaaatgccatttttttgctttttagttttatgtatttttgtatgtatatacccacatttttacattgatttatgttctaaataataattaaaacaaagtattataaaatgaatgaaatatttttgtgttccatggtcaaattattaataaattcaggaaagaaaatctgatgataaatctgatataaataccagaataattattattaatataaaataatattttcacatatgaaggtatgtcttcatactacaggatttctgacttgaatatattctataatgctttaattcattaccataacaaatgtactaagaattaatgttgcatctttagtattccattttttggaactgtttttcaaatgttctatatcctctagcttattatgctatctaaaataatttcagtgtgttttttcctggggcaactgaatgattcttgttttgaatgagtgataaaatgttttgtgatagtatctaatatttggtcctttacagaaaaaatggcttgtggtactatattgaaaaaactattgtatttcctcaattttactgtgtgttgtcttgtttctataaacaaaaataagttttggatttgtttgaataat

SEQ ID NO: 7022 - DNA, 544 bp, Homo sapiens
ccttctggtatcttcttctttgtcttcccctctcaccactcttatagattcacttttttgctcaagccttcagcttaaattatattcaattaatctaacagaagagttatttgtgctttgtaaatataatcagtctttcccgagtaactgtctacagaaggctgtttgctgtgaagcgtcgttgaatacttttctgtgtctgtggtttactggacttgaaactgtttatttgaaatgttattttctggaatgttctggtgtcagtggacaaagcctatggccaatgatgctccaaaatgctcatttggcacttagaaaataaactaccatccatcccaaattcttccaactgtatcattttctatgaagttagaattttgagtttccaggtctaaagaaatgaaagatatgagaattaacagtattacctggttgttggaatgtggaatatataagaaacatttttccagaaaaaatgtaaatgttgagcctcctgactgtgattactatagagcttgaaagtctatgtcttagaaaaatattt

SEQ ID NO: 7023 - DNA, 427 bp, Homo sapiens
aagagaatacagagtaaaggagaagtccttgtcttccaaatctctctctggatgggactttgagaaaactaccctttttaaaaaatttttttgagacagtctctcactctgtctcccaggctggagtgcagtggtgcagtctcggctcactacaacctctgtctcctgggttcaagcgattctcctgactcagcctcccaagtagctaggattacaggtgcatgccaccatgccaggctaatttttgtaattgtagtagagactgggttttaccatggctggttttgaactcctgacctcaggtgatccaccagcctcggcctcccaaagtgctgaaaatacaggcatgagccaccgcccctggctttttctttttctttttctttttttttttgtaaattaagtaaactgtgtcgttggaggtggg

SEQ ID NO: 7024 - DNA, 294 bp, Homo sapiens
tctcagcacttggcatataggcacataataaatatgaatgaatgaatggattcctagtacttcttgcttctctttctatcatagtcatcatgattatgatgcagtacctagtgtgtctctacctctagaatgaaacaaagaaagctgtgtttttgtcttgctcaccttatatacccagcacttagaaggttctccaaattatatctactgcatgaatgaaggtttctgagatgctaatctgaccatcttcacccgtttctgcccttaaagcttactgccctcagtatcgaacct

SEQ ID NO: 7025 - DNA, 485 bp, Homo sapiens
ctgcgacaagcgtcaggctcacgaagagagggggaaatgcctgaatataaggaggtccagggagctagtgttaaaaactagaagaaaacagatgcccttagtatctgaccactgggcaggacaggatattccaaacttaaaatgaagagaagaaatcacacatgtgcacacacaccccacacacacacccatatgaagtttgaatacaaaggttagtatcctgcatgtggaaagcaaaattaaactttgagcagcagaataaactttacaatagatatgaaggaaaattcgtcagtgtatatgaggaatactaaaatctatcaggaaaatataaaactccccagaggaaaataggagcaaagaggccgggcacagtggctcatgcctgtaatcccagcactttgggaggccaaggcgggcagatcgcatgagctcaggagtttgaaaccagcctaggcaacatggcaaaaccctgtctccattta

SEQ ID NO: 7026 - DNA, 437 bp, Homo sapiens
gtcttgccacttttttacaaatttcatagccagcacgatggctcatgtgtgtaatcccaacagtttgggaggctgaggtgagagtatggcttcaaatcaggagtttgagactatcctgggcaacatagcaagaccctgtctcaaaaaaaaaaaaaaaattaggcaggcatcgtggttcacacctgtagtcccaattactcaggaggctgaggtggagggattgcctgagcccagggttcaagactggcctgtgcaatatagcaagaccccatccctaaaaaataaaaaacacctatcagggtgggtgcatgccagtagcctcagctactcaggaggctgaagagagaggatcacttgagtccagcaggttgggacagcagtgagctatgattgtgtctctgtacttcagcctgagtgacagagcaagaccctgtctc

SEQ ID NO: 7027 - DNA, 240 bp, Homo sapiens
aataagaggatgaaggatgaggaggaggaaaattaaattatacaattgtaaggttcttacattgtttgtggtcatttaatattattttaggctgggcgtggtggctcatgcctgtaattccagctactccagaggctgaggcacaagaatcactcgaactcaggagatggaggttgcagtgagacgagatcgtgccactgcactccagcctgggcaacagagtgagactctgcctcaaaa

SEQ ID NO: 7028 - DNA, 495 bp, Homo sapiens
cactgaattaattgctgttgaaaagaagtcaagtttcttttcatttccttcctaaaagcagtttcctttcctttaagactcactccaggtctctgattctttgattctgaaacactggaaaagcaatcaaatagcagatgccaactctttgtatgttgagcttttggagttttggaaagttgggtctgaacctagaagtgaatttacattacgtctttcctcttctagaggtttcctttggcctatagctttcacatgggagagaaaaatgctggcctaccctacagagattggagtcaggggagagaaaaagggagaaaggtagtgaaaagaggagaggaaacaattatcccttttaaaaccatcctttttggtggcttgatagaaatactctgtcagaaatgctgtttggtattcgttgccagagctagacatcaagggcttagtctcgtttgaaatgtttaggctttagaaggagcaagataagtggggaag

SEQ ID NO: 7029 - DNA, 381 bp, Homo sapiens
taagttatagcaggaggactttaatatagcagctgacagaacttcctgatcataagggatgtgaaaaacttcaaagaaatactgtttccatttgagatgaaaaacaacacaaacaattctccatttagaagtaatattacctagaaaaggagaaacggcttaatgtcttaagattcccatgtttttttcactaacatggagaaaaaaatgacagaaaaaggaaactctagagcgctctatatataaaaccctcagcctgtttacctgagtcctttggggactgagtagttttgaacagctgagttttctggtaaactatgtgtttatcattctaagaattaagtttggataaaaatatctactaaaaatatatttaaattc

SEQ ID NO: 7030 - DNA, 478 bp, Homo sapiens
acccttagggtgttctgacttaggaaaccccatgtgtggcttagctgggcagtggcttcatggcatggggtcacctcatacagccacaggcccaaataagctccaaagatcattgaacctgcttctcagccattcagacaacatcaacaacaacagatgacaatcagcttataactacagattcactgagccagggcacctttcttcaagtcagaaaattttgtcctcataaggagactacttaaatctttacttcactgcagcttaagtcaattttctcttctagcttcaaatggggtcagtaggagtgatcataatctctccaaaaatggtttccactctctcaggcttttatacaatgatgctctattggatattaacagattttcttcttataacattagattgtaagtttccatgaagtgcagttattattttcagattctttatttctcttttaagatgacagcacatgact

SEQ ID NO: 7031 - DNA, 508 bp, Homo sapiens
aggagatggcttcgttccctcaatcactcatccaaagacgtttaatgagcacctattgtgtgtcaggcattgtaccgggcaatggggatatcgtagtcagtaataagtgaggagagatgagttcatttgtgagaggctctgaccagtggaatcagaggaagggagttcccctgggtgggccaggttcaaagacattttggaagtagaatctgcagaacatgatgatcttttggaaacagggcagggacgtgaatgagcacgtaatgtccccatgggtttgtctttccgaaggtttaaaatcctcaagaataaggaacataggcatgtgtcgtaacggtctccacagtgggggagtattatgttagtgcacctgcatgttaactctgctcatgaaggggccacgtcttcaccaccacaaagcctcaagcatgcatatctggtccctcctaccccctccctattgaggtgcaataaaggcccatgtttctcctagtatgggaacagaact

SEQ ID NO: 7032 - DNA, 566 bp, Homo sapiens
ttttttttttagacggagtctccctgtcgcccaggctggagtgcagcggcgcaatcttggctcactgcaagctccacctcccgggttcacgccattttcctgcctcagcctcccgcgggggactacaggcatccgccacctcgcccggctaattttttttttttgcatttttagtagagacggagtttcaccgtgttagccaggatagtctggatctcctgacctcgtgatccgcccgcctcggcctcccaaagtgctgggattacaggcgtgagccaccgcgcccggccaattcatttgttaactattcttagcaccttcgctacaactgcaattccaagcctttcctcttaataggaaatcaaaacttgtcatttcaagtcttcaactgtgtactctacactctaccaactacaatgacttctctttcgaaggcaatacaaagaaaagctgaacccacttcctttctttctttcctcctccaaaactccctccgccattaaacaagagtcagaagagcaggatttgggcctgagctcaggcattactgcagtacgaggcccgtt

SEQ ID NO: 7033 - DNA, 927 bp, Homo sapiens
cagccccaggtcctaccccagacttaatcaaaatcggtatttttgctcgaggacaggaggtcaagaccagcctgggcaatatggcggacttggggcttgaacagtgcacagtcaagatggctgctgggtccagaggcttccacagaggacaggagaggcacccctgcatcccaggctcagcagaagatgccatccatctagagtgagactgaaaatacaaacaattcagaagttgtgactttccatgctctgcccacagaggctaccaaatgctaagggcgcttcctccccagcaccaggcttatggttctaagctccagaaaaatatcaaataaaccctgccctcgaggagaatacattcctgtcagggtttatcttccacaacctccctcccaccagcagtccctagggcacaaaagctgctaatgacctgtcaagctgaatgtcaccgcatctccatccttctccactggccttggcagggatgctaatgaggaggcttggggcaggcagcaaaaaggataatgtaaagcagggacacaggctgccagatatcccattttcccaaataatacatccaaagggtttgcaccaaactgtgaactctcaaaaaggaccagaggctagttacagacacctgactgcaggagtctaaacagatctagagccaaaaaaactgcataaaactattaaatttaatgatacggtttggatgtctgtcccctccaaatctcaagttgaaatatgacctccagtgttggaggtggggcctaaaggaaggtggtggatccttcatgaatgttttggtgccatcctcacagtgagttctcactctaagttcacgtgcaatctggttgtttaaaacagtgtggtggccgtgcgcagtggctcatgcctgtaatcccagcactttgggaggccgaggca

SEQ ID NO: 7034 - DNA, 552 bp, Homo sapiens
ttttttttgttgttgggacagagtcatgctctctcacccaggctggaatgcagtggtatgatcatagctcactgtaacctcaaactcctgggctcaagtgatcctcgcacctcagcctcttgagtggctgggactacaggcacgcaccaccacatctggctaattcttttcctttttgtaaagacagggtctcactatgttgcccaggctggtctcgcactcaaggactccagccctcctccggcctcagcctcccaaagcactgagattacaggcgtgagccactgcacctgtcctgcgctttccttatcctgcagtaagttctcaatcacctcttccaggcggacttggggcttgaacagtgcacagtcaagatggctgctgggtccagaggcttccacagaggacaggagaggcacccctgcatcccaggctcaggtgggtgctaactgccagcagctgacagttgtcacagattgataatagctaacagcacatctctcccccggctccttccctagtgcaccaattagcccagcctcatctgcacct

SEQ ID NO: 7035 - DNA, 843 bp, Homo sapiens
taagtttcttgaatgttattacatgtagcccctttaatgaatttgattaaattcaaaatgaataatttatgtctgatgaagagacttttatttataaaagcaaataaattagaaataagtttatttttctgggcacaaattattcattttaaatgtttattaagaattgaatcttgattagttgttaacatcaaaagccaatatgctagcaagcaatatgaaacaagcaatccataaaatagctatcagaaaaaactttaaaagtcaattgttttctctttaaaacctcttataccaggttgatactgatcataatcatatgctagtgaaaaagtaaaaaattggggggaaaaagcttaacatttgtacatgcacatgcaaaacaaaagctcccttgataataaagggattgcagatataatgataaactagctgggatgattcaacttgattattaaggagagaaaaagattgtaaatcattattttataacctacctgtttttagtacaactagttgggaaattttgccctagattatatcacctgccgaacaatccagagttgtcttttaaaaatggcaatcatataatttcaccttcttcttgtaaactttccagtggcttactatcacatgtggaataaaaatcagattttttacactgtagctgagaatgtatatataggctattgcctacaaagaaagttaaactgaagctggttgtggtggtatgtgcctgcagtcccagctgctggagaggttgggccaggagggtcacttgagcccagaagtttgaggccctggcctacatagtgagaccctgtctcaaactgaacaaccaac

SEQ ID NO: 7036 - DNA, 573 bp, Homo sapiens
tttcactaggtactcttgtaattctgccttggatccctggacaccctggattttatttttaggatgtttgcccacaaattgttactgtaaatttttttttaaaaaaaagcctaacagttaatattaattaccttgtttgttacgagaatgaatggctcggatgtgagccactgcgcctggtcaagaggtagtttttaaattcataaaatgggctgggctgggtgcagtggctcatacctgtaatcccagcacttcaggaggccaaggtggagggttgcttgagcccaggagttggagaccagcctgggcaacgtagcaagaccctgtctctgcaaaaaatataaaaattagctgggtgtgctggtatgcacctgtagtcccagctacttgggaggctgaggcaggaggatggcttgagcctagaaggttgaggctacagtgagccatgatcatactattgcattccagcctgggtggcaagcaagatcctctctcaaaaaaaaaaagggactggattacagttttgattaaaatatgcttgaagttaataacctattctggcttactgaacac

SEQ ID NO: 7037 - DNA, 536 bp, Homo sapiens
gaccactatgccctcagcccacctgcacttgtctgcagctgaggctagtcccaggcaggctgaatttcttgcctgaacatttccctctaggagctaggctgaatacaggtgtatcctataagaagtttggacgtggagttgattctgtgctcaaccctcagccaaggagggacgggagttgatagataaatgctccacctcgctgtccccagttgtgtcacttctgaggtgtgtgccatggagtgcctcaaagggttccagcaggaccatgccctggatgtccaagaggtaacttgctcattcatgcaccctcaaacaggcctgggactacttctcaaataaacgacccgcagccttttctcaggatctgcttttgggggagccctaagacaccatcacatagacataaatctttttttttctaaactccaaataatataatcaggctctatggatttttaagccaaggaatcaatctttccatgtgagttttccttgctataatacagaaacaacttctctttgaatttagcttt

SEQ ID NO: 7038 - DNA, 513 bp, Homo sapiens
aaaaaagatctttttaaaatctactatatgtctgctcaaacttaacatttaatgtatcagaaaatattacagaattatttgtttgttccagttatgttaactaaatttcattcaagatttagtcacttatagaggacaacaactacaagtaaatgagaaaaattatatatgtgtcatatacaatgaaaaggccagtaagaatctatatgtcctccaaatatcagagaaagatgatgctgcctgatcctttgattcttcttttgtgggacagaggaggttcatttcttcataaatttctgaggccctgcccttcctagactagcagaatatgtctggctccttccagaatggctgacagtctgtcatgtctctccactgcccattgcccctgacctcttccttcctcttctgcctgctttataacctcttctagattcaaacagtccagttttctcaattgtaagcaaagactagccttgataagtgatggggtccattcctagcctaacattt

SEQ ID NO: 7039 - DNA, 533 bp, Homo sapiens
agctgagacatctgtcttctctggcccatggacatcggaacacctggtctcaggtcttcagactgtggggcttacacgagcagcccccctggtttgcaggccttttgacttggtctgaattataccactggctttcctggttctccagcttgcagacggcatgttatggtacaacttggctttcataatggtgtgagcccattcctgtaataaatcttttatatgtctttatatatcctattagttttgttcctttggagaaccctgactaattcagaaattatttatgttaacatgcattgcattcatcattgctgttttcacatgaatcaatcaataaatgtttttaaaaattctgttttaatttttaattgaaaaatattgatagttataatccacgtaaacaaaatctttttggaattctcaatcagttttaagagaacaaaaattttgataactactactttaggatgaaactacagatgacccttgaacaacacaggatttaggggcactgtcccctcattgcagtc

SEQ ID NO: 7040 - DNA, 1256 bp, Homo sapiens
tgccttttaaacgcttgttctgtctctttctaactcctttgtctccgccggactcggggtatccgctgggtggtgtggggctggtttccccaacagctttctctccacccagcttcatagatgacaccctgcctgctaggccagatgttctccggccaagaacactattatagctgcctggcttctccctgagcagcgtcaggtgtgaggagtgcgcatggcagctgcccagtgacagatggaatctccctctctcacccaggctggagtgcaatggcacaatcagctcactgcaacctccacctcccgggttcaagtgattcttctgcctcagcctcccgagtagctgggactacagccttcatttcagtcaacaaccacataacagatcatcaaaatacataaagcaaaaactgacagaactaaagttaaatatacatatctacaattatggagagaataacaaacaaaaaaatagaacaaaaatgttccacgccttggtcaatggtaccaccagccagcgaggttcccaagccaagaacttcggaagcatccgtgattcttcatcttccacatccactttatcaccggaagcacgcattcaactttctaaacatccctcagactgacccacatctttctatccacttttcacatcttgcttgaatgacttccccaggcccagccagtctcccgcctccagctccgcccccttctgactccctttatgtggtacaatcagagagcccttcccaaagcacaaatctgctttcactgctttgcttcaagccctttcgtggctcctatttccagctggatgaggtccaagcctcttaacgtgctgtacgtgtacatgcctgacccccgctacttgaccagccaagtttcttcatagcgctgtgtctttgttcctcctgcctagaatgtccttccccttttctctcgcttcatggtgtgccaaactcctatcctgtgagatccagcttacacgtcagcttccccgtgatgcttttcctaactccctattcagccagtgaagtgctccctgcgttcccatgtggcttgtatctctgtaaaagctccacagagctgttttaatttatccgttaatgtacatgtcttccccactagacttttgctccttaaagtatctccttcatctctgctttgcataacctaacagagttcaacacataggagtgtcttaataaatgctgaataaaataattaataaacaaatgaaacaatacagcaaa

SEQ ID NO: 7041 - DNA, 366 bp, Homo sapiens
ccaagacgaggggcaacgatgcttgtccattgtctgtgcaggctagactggaggaaagggccttggggaggaacttaaggtagatggaatttgctgatggaaatgttatttacttgatcaaattttccactggcattggtacatacttccctaaagagggttaaaaataagaaaggccctcctgggagtcaggagaagtgatgagatgtgctgtagctaggcccttcctttgtgaaatggagtttatgctatagccagatgtcacaatgctcaacaaatgactgaagtccatcgtaaacaacaccaaaaacaacgaaatgcatttattttaaaactactattttgaaaaaacacagtccctatggc

SEQ ID NO: 7042 - DNA, 378 bp, Homo sapiens
aacaaattaaaagaaatccatgttcaaactgctgaacaataataacataatacaaatcttaaagcctgacaggtttattatcataggggaaggatgatttgaaagatagtggaattcttatcagaaaacaggcaggctagaatgaaatggcacaacagttttaaagtactgaatgtagaatattaggttgactgttctttttctctatctttctatagccttctccccttctttacatgtcctcctgtcttataaggacaccagatatttactctttagtggtattgttattcatgttaaatctatgtatgttactatttttatatgacaacattataacttttcctttaaagtcaaatgcttttaaggaatgtagat

SEQ ID NO: 7043 - DNA, 431 bp, Homo sapiens
gactgtatcttaaatgaaaacttcacttgatgagattaattgattagacactgcagaaaaaaatctgaacttgaaataatagaaatagaatcaattgcaaaggaagcacagggatgaaagaagactaagaaatcaaacaaaaacagagactcagttgcctgtgggataataccaagtgatctatcatatgtgtaattatagttctatgggaaatgagaaggtggagagacaaaagttatctgaaaaatgatgaaatagtttccagatttgatgaaaagtataaaccaatagatctgaggagcgctcaatgaaatccaatgaaaacgaaaaaagaaaacaatgcccaaaacatgataaaattactgaaaacaagtgaaaaggagaaaattgtaaatgcagcaagacctcctccccaaaaaaagataaagaat

SEQ ID NO: 7044 - DNA, 376 bp, Homo sapiens
gttagtctgaggttgctcatttccagcaaaactttgaatatggctctctgtgcatcatttctagaaggataccagcagcactctcacagtcttgcccactgtatcatctactttgtcctgcagccaagattctctctttaaaacatacaccagattatgccccttaaaatcctccagtggtgcttttcaacttcagattgttacatccaaggcctcactgaatctgtttgtgcctacttctctgacctcttctttttctgctctcttttactcattaatgccatgtcacatgggccttctctcattttcacaacagaccaaatatttgcattttagggcctttgtgcttaagataccctctgcttagactgttctg

SEQ ID NO: 7045 - DNA, 472 bp, Homo sapiens
agtttgccatctcacatggtcatggtccatggtgtcccaaataattacaatagtaacatcaaagatcactgattacagatcacaataacagatataataataatgaagaaactaaaaatattgtgagaattaccaaaatgtgaaacagagttatgaaatgagcacatgctattggaaaaaaatggcactgatagaattgcttgatgcgaggtttctacaaaacttcaatttctaaaaaacacaatgtgttttgcaaaatgcaaaaagtgaagttcaataaaatgaggtatgcttgtatatctagacaatattttgctgaaaatatgtgctcaataaagttacttaatagaaatttacaactaaatcacttaaatacaatttttttgttattttttattttacgtggcctttatatgattatgtaatcttttgcaaattctacttctaaaagcatttaaagtaaccagacaag

SEQ ID NO: 7046 - DNA, 667 bp, Homo sapiens
agtgttattttttttttttacagcaccttgttcactgatagtgttttttttaataggacataaaggttatagaatgtttatataggtttttaagtaatagtggtatctttcaaatattgccgaatgttatttcaataactacctctcaagttctgtttttaaataaatgaatttcttttaatcaaagattaaaattaattgactcctgacttgactataggaagttttatgtcacacagaaattttcactacaatatttgttatcatggaaccttacctgtgtgagatgtagataaatcaaaagaaaaacataaagtttactagaaagaaaatgctataattgtgtccccctagaaattcagatgttgaagtcctaagccccagtagctcagaatgtgactgtatttggagataggacctctgaaaagttacctaagttaaagtggggtctttaagatgaacgttaatccaatatgactggtgtccttagaagaagagatgaggacacagaaaacacagggcaacggccatattaagacacagtgacaaagcagccatctacaaggcaagaaaagaagcctcagaagaaaccaaccctgccaacaccttgatctagcctccagaattgtaagaaaataaatttctgttgtgtaagccacccaatgtg

SEQ ID NO: 7047 - DNA, 400 bp, Homo sapiens
agaaattgggcataagacaatatgaggggtggtctccgcccttaatctatattgcctcgctctgtccactaaagagggtctgggaactgcagtccaccaataccagtaagaaaaatttgtgttctaaatacctggttcttggttgctaaatgctgttccacactaaaaggaaccagactttttaaaaacattttactttaagttctgggatgcatgtgctgagcatgcaggtttgttatataggtatacatgtgccatggtggtgtgctgcacctatcaacccgtcatctagcttttaagccccgcatgcattaggtatttgtcctaatgctctccctcccctttccctctacccactgacaggccccagtgtgtggtgttcccctctctgtgtccatgt

SEQ ID NO: 7048 - DNA, 384 bp, Homo sapiens
atggaatgattaaggaataaggatttgaaatgatagatatgtttattaaaccaaactaatgaacatattcatcatttcaaatcctttttgttggggcagggtgcagtggctcatgcctgtaatcccagcaagttgggtggctgaggcaggcggattgcttgagtctaggagttcaagaccagtttaggcaatgtggcaaaaccccgtctctacaaaaaatacaaaaaaattagccgggtgtggtggtgtgcgcctgtggtcccagctatttgggaggctgaggtgggaggattgcttgagcttggcaggttgaggctgcagtgagcgatgattttgccactgcagtccagcctcggtgacagagtgagactttatctaaaaaaa

SEQ ID NO: 7049 - DNA, 476 bp, Homo sapiens
tttttgtatttaacctgcttggtgattgctgagattcctgaacctatggtttcatgtctgtcattaattttgaaacattctcaactgtcattattttaaatatttcttctggttctcactctcttccttctacttctggtattccgattatgggttacataggttacaccgtttgaaattatccaacagggccgggcgcggtgactcacttgcctgtaatcccagcactttgggaggctgaggcaggcggatcacaagttcaagagatccagaccatcctggctaccacggggaaaccacgtctctgctaaaaatacaaaaaattagctgggcgtggtggcaggcgcctgtagtcccagctactcgggaggctgaggcaggagaatggcgtgaacccaggaggcggagcttgcagtgagccgagattgcaccactgcactccagcctgagcgacagagagagactccatctcaaaa

SEQ ID NO: 7050 - DNA, 953 bp, Homo sapiens
gcctactactactaaattcgcggccgcgtcgacctattctggaataatacctgatactgtactacatttcagattttccagaactgtttttgttttgcattctttcttttgagcctcacaataatctttaagataattggccaggcatggtggctcacgtctgcaatcccagtactttcggaggctgaagcggtggttcacttgatgccaggctgctcttgaattcctgacctcaggtgatcctcccgcctcggcctcccaaggtgctgggattaaaggcatgagccactgtccccggccagaagcaagattcttttacgatacccctgattcagtttgatacatgctattgattgcttaaaatttcctactaaaaaattaatattctcaactaaattgaacttgtgccaaaatcagcatgttctcctatgcctcagccagttctaatgtaataggagatgcagtttatttaagctatttgcaagtgtaataacagttgttgttttaagaaattatttttatttttagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7051 - DNA, 1956 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtgtgccaagcaattatttcatgggaaattaaccagaacttgaagaaagttgccagtggcatcagccatttgtttcagtagaactgttcagagcaccgttcttccacacttggtcttgcccagcctagcaaccggattgtcaccatggtgagaagccgccaactttttttttttggcgtgtacacaggcagatggtgtactgtccccattctgtacaccttgttccagattttttttgtttgaaattatacagtgacaatactcacaaagccaaggggagtagttaaggtataatttg

SEQ ID NO: 7052 - DNA, 1981 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtgaaaacacaaaaacacaaaaacaccaacaacaacacacaaaaacaaaaaaaaaaaaaaaaaaaaaaaaaaaaaaaacaacaagacccaaaacaacacaaaaaaaaaacaacaaacacaacaagaaaaaagagaaagagaagacagaaagacgagagaagcaggacgagagagagaaaaagataaaacaacaagagaaaagaagagaacacacagaacagaaagagaaggagacaaccagaaaagaggaaagagacagacaagagacacagacagacggaacaaaagaaaaggaaatacgaacaacaaaatgaacaacaaac

SEQ ID NO: 7053 - DNA, 1754 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaagagtctcgctctgttgcccaggctggagtgcagtggcgcgatctcggctcactgcatcctctgcctcagcctcctgagtagctgggattacaagcacccgccaccatgcccagctaatttttgtatttttagcagagacagggtttcaccatgttggccaggctgctcttgaattcctgacctcaggtgatcctcccgcctcggcctcccaaagtgctgggattaaaggcatgagccactgtccc

SEQ ID NO: 7054 - DNA, 1736 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagacggagtttcacccttgttgcccaggctggagtgcaatggcacgatctcagctgactgaaacctccgcctcccagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7055 - DNA, 1521 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7056 - DNA, 1295 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcgtcaaaatcggaatcctctagagtcaccg

SEQ ID NO: 7057 - DNA, 1487 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcgggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7058 - DNA, 1350 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7059 - DNA, 2445 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacatagtaagggactcgcacggccaggtgctgggcggggaggccccgcggtcggtcagggcgggagagaaaggtgtggatatccctgggtatgaagagaaaactttaggtcgtgtttgtcgctatcctgcctttgctaagctttctgtttcgccagttgttacttgacttagccccagctggctaggttcagacctggcgctgtctgatttggaacaaatcactttaacgtttctgaacctcagggtcctcatccttaataggcagttaagaacctctgcctccaacagccattcagccagtattatcagatgcctgaggtgccaggtaccgttctaactcccgggagatgcggtggtgagcaagacattgctggtccttgccctcgaagttggtgggtggagctagacaaacaggaacttttcagattgtgataaaggaaatagagggttactaagtggctgtgcgctattcctttagaaggtgatgtctgagttgaaattcaaaaaatgaaaaagaataagtgatgtggaaagcagttcaggcataggaaagagtaagttcaaaggccctgtggcaggaaagaagtcagagcattctaggaacagaaagtgccccttgtggctgcagagcattgagggagaggagtggcacagcatggggtgcactggggacagataacacagggtttcgaagaccacagttagactgctgtgtaaaaaatggatgtagggccaagactgaaagcgtggaaaccaagaagcaaccatgaaatggtggtgtgtatacaccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7060 - DNA, 1682 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacatagtaagggactcgcacggccagccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7061 - DNA, 1582 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacatagcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7062 - DNA, 1778 bp, Homo sapiens
  misc_feature (159)..(159): n is a, c, g, or t
  misc_feature (186)..(186): n is a, c, g, or t
  misc_feature (189)..(189): n is a, c, g, or t
  misc_feature (221)..(221): n is a, c, g, or t
  misc_feature (257)..(257): n is a, c, g, or t
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacatagtctcnctctgcctctcaggctgtagtgcagtngcntgatctcatctcactgcaacctccacctttcnggctcaagcggtcctcctgcctcaacctgccaagtngctgggacttaagccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7063 - DNA, 1719 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataggccaagactgaaagcgtggaaaccaagaagcaaccatgaaatggtggtgtgtatacaccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7064 - DNA, 1400 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7065 - DNA, 1626 bp, Homo sapiens
ggcatcgagggatcccggatgtggatcaagttggtgggaagcgtgcggtgccgcagcaatggcggcgctcacaattgccacgggtactggcaattggttttcggctttggcgctcgggccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7066 - DNA, 980 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtatggtagcgaaattcaattact

SEQ ID NO: 7067 - DNA, 1695 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgattgtttctgtttctttcctaatgtttcaatgtaggtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7068 - DNA, 1132 bp, Homo sapiens
  misc_feature (41)..(41): n is a, c, g, or t
  misc_feature (59)..(60): n is a, c, g, or t
  misc_feature (62)..(62): n is a, c, g, or t
gaaattaaaaatcgccaaaaggcaaggggggggggggctanctgcaacgactctcttanntntccaccgctacacaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7069 - DNA, 1135 bp, Homo sapiens
  misc_feature (44)..(44): n is a, c, g, or t
  misc_feature (62)..(63): n is a, c, g, or t
  misc_feature (65)..(65): n is a, c, g, or t
catcaattcctagattaagaatataaagagatatgaaaggctanctgcaacgactctcttanntntccaccgctacacaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7070 - DNA, 1205 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcttttattctctcctgctcagagaataaaagcagcagttcatcagccactttgagatgggacccaaagagggtattggaggctaactgcaagtcccagaattagaggggtcacaatggcatctgtgtagctgttaagactggcaataaagtcacgatcatggtataaaagtcttccttatgccttcctcgtaatatcccatcaaaccttttcaagtgcctatcaactacagacttaaaaaactccttcaacatgtggcttaccactctcagtgctatacctcaactttctaggttacatctttttttcctgatccctaaaacaagatctaaaataatcacttggcctaaaatctttttttc

SEQ ID NO: 7071 - DNA, 954 bp, Homo sapiens
actgataatgttccttttctgtagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7072 - DNA, 1376 bp, Homo sapiens
  misc_feature (1347)..(1347): n is a, c, g, or t
  misc_feature (1349)..(1349): n is a, c, g, or t
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacatagtaagggactcgcacggccaggtgctgggcggggaggccccgcggtcggtcagggcgggagagaaaggtgtggatatccctgggtatgaagagaaaactttaggtcgtgtttgtcgctatcctgcctttgctaagctttctgtttcgccagttgttacttgacttagccccagctggctaggttcagacctggcgctgtctgatttggaacaaatcactttaacgtttctgaacctcagggtcctcatccttaataggcagttaagaacctctgcctccaacagccattcagccagtattatcagatgcctgaggtgccaggtaccgttctaactcccgggagatgcggtggtgagcaagacattgctggtccttgccctcgaagttggtgggtggagctagacaaacaggaacttttcagattgtgataaaggaaatagagggttactaagtggctgtgcgctattcctttagaaggtgatgtctgagttgaaattcaaaaaatgaaaaagaataagtgatgtggaaagcagttcaggcataggaaagagtaagttcaaaggccctgtggcaggaaagaagtcagagcattctaggaacagaaagtgccccttgtggctgcagagcattgagggagaggagtggcacagcatggggtgcactggggacagataacacagggtttcgaagaccacagttagactgctgtgtaaaaaatggatgtagggccaagactgaaagcgtggaaaccaagaagcaaccatgaaatggtggtgtgtatacaccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcatttttgtcctttttcttgcncnataaaattataaggtcataaaaaaaaa

SEQ ID NO: 7073 - DNA, 618 bp, Homo sapiens
tcgatccgctcgtgccgttgctaggtggagtgcactggacgactctcagtactgaaactccgctcccagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtgtgccaagcaattatttcatgggaaattaaccagaacttgaagaaagttgccagtggcatcagccatttgtttcagtagaactgttcagagcaccgttcttccacacttggtcttgcccagcctagcaaccggattgtcaccatggtgagaagccgccaactttttttttttggcgtgtacacaggcagatggtgtactgtccccattctgtacaccttgttccagattttttttgtttgaaattatacagtgacaatactcacaaagccaaggggagtagttaaggtataatttg

SEQ ID NO: 7074 - DNA, 368 bp, Homo sapiens
tgcttggttcaaactgtatgtttcagtattgattgactctgctattggcaagacaaagaaacaatgaataaaggaactgcttagatgtgtgccaagcaattatttcatgggaaattaaccagaacttgaagaaagttgccagtggcatcagccatttgtttcagtagaactgttcagagcaccgttcttccacacttggtcttgcccagcctagcaaccggattgtcaccatggtgagaagccactggccctccataagcactgaaacacatctgaaaaaaactcacctttccctattaaaattgtctgagatcgttcagactgctgtgcttgctcaagccaaacagggaatctgattaaccgcataa

SEQ ID NO: 7075 - DNA, 1661 bp, Homo sapiens
ggcatcgagggatcccggatgtggatcaagttggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttctctttgctgttctcctacatttcaagcatatctacctctatgtagcaccagcttatggtgtatatctgctgcgatcctactgtttcactgcaaataaaccagatgggtctattcgatggaagagtttcagctttgttcgtgttatttccctgggactggttgttttcttagtttctgctctttcattgggtcctttcctggccttgaatcagctgcctcaagtcttttcccgactctttcctttcaagaggggcctctgtcatgcatattgggctccaaacttctgggctttgtacaatgctttggacaaagtgctgtctgtcatcggtttgaaattgaaatttcttgatcccaacaatattcccaaggcctcaatgacaagtggtttggttcagcagttccaacacacagtccttccctcagtgactcccttggcaaccctcatctgcacactgattgccatattgccctctattttctgtctttggtttaaaccccaagggcccagaggctttctccgatgtctaactctttgtgccttgagctcctttatgtttgggtggcatgttcatgaaaaagccatacttctagcaattctcccaatgagccttttgtctgtgggaaaagcaggagacgcttcgatttttctgattctgaccacaacaggacattattccctctttcctctgctcttcactgcaccagaacttcccattaaaatcttactcatgttactattcaccatatatagtatttcgtcactgaagactttattcagaaaagaaaaacctctttttaattggatggaaactttctacctgcttggcctggggcctctggaagtctgctgtgaatttgtattccctttcacctcctggaaggtgaagtaccccttcatccctttgttactaacctcagtgtattgtgcagtaggcatcacatatgcttggttcaaactgtatgtttcagtattgattgactctgctattggcaagacaaagaaacaatgaataaaggaactgcttagatgtg

SEQ ID NO: 7076 - DNA, 414 bp, Homo sapiens
acctccgttaggtacgtgaatttagttttcagcaaattattcctttggtttcccagaagcttccttcacattccagctcctcaagtaaatgttaaaagtttaacaaggaaaaggagtgaattgattttgtatatatttttgtttggtgaaatagcagagtgtaggcatagtcttttcagataagtttgctaaaaagtagtttcctgtcacctccctttgaaaagaactgaggtgtgccccatcctcaaacctaccatctttccaatttatttgtttattggggtagtaggtgggaataaatgtttcttagatttttctggcctcccttcctaagccagggtagctcctggcaaatagtccccagacaaaccttaactgggccgccttcctggaacctcattttatacccaaaat

SEQ ID NO: 7077 - DNA, 783 bp, Homo sapiens
caagttgtcctgtgtgtacaagtatctcatggacattgatgtgaacacatgaacaactttctttacctctctgttctcatccccaccccatctgatagggtttggctgtgtccccattcaaatctcagcctgaattgtatctcccagaattcccacaaattgtgggagggaaccagggggaggtaattgaatgatagcagctggtctttcctgtgctattctcgtgatagtgaattagtctcatgagatctgatgggtttatcagggatttccacttttacctcttcctcattttctcttgctgccaccatgtaagaagtgccttttgccttccgccatgattctgaggcctccccagccatgtggaagtgtaagtccaattaaacctcattttctttccagtctcaggtatgtctttattagcagcatgaaaacagactaatgcatcacctcatcattgtaggatttgagcagtttaataaaaatgcgctattttggtcgggcgcggtagcccacgcctgtaatctgagccctttgggaggccgaggcgggtggttcgcaaggtcaggagatcgagaccatcctggctaatgtggtgaaaccctgtctctactaaaaatacaaaaaattagccaggtgtggtggcaggcacctgtagtcccagctactcaggaaggctgaggcagaagaatggcatgaacccaggaggcagagcttgcagtgagccgagatcgcgccactgcactccagcctgagtgacagagcgagactccgcctcaaaaa

SEQ ID NO: 7078 - DNA, 326 bp, Homo sapiens
tcattctgaaggttgccttttcattctgttgatgggttttgttttttgtgtgtttttgctgtgcagaagccttttagtttgacgtagtctcaagtgtctatttttgcttttgttacctgtgcttttggtgtcatgtctaggaaatcattgtcaagaccaaagtcaggaagctttttccctatgctttcttctaagggttttacagttcaggtcttatatatgtttttaattcacttcgagttgatttttgtggatggtgtaagataagggtccaattttattcttttgcctggggatgtccaattttcccagcagttaaaaaaaat

SEQ ID NO: 7079 - DNA, 463 bp, Homo sapiens
attcgcggccgcgtcgacattaggctgaattctttctatctcacaatttaatgtgtgcctttaggaaaatcctagaagacagagttgcctaagaatatttaacttcagattaaggtatttataaagacaaagcagtctcttgacatattctgacatgtgaacctctgctctgagctgtgagtagaaggacctcttctgacagggtcccaaagggcttaagacaggggtctgttccattgtctaatgtgctccagtgtgataagttggaggcacattctgcattgacctgaatgtgccagtgggttggcaatgaggctgcaagcacctccaagcagctgccatagtagagaaatggactctggccatgggaggccttgtcatcttccccaggcccctggaagaattttccatgcagccaagggctcaatactcgtgggaattaatcacttctgggcagtgctgg

SEQ ID NO: 7080 - DNA, 378 bp, Homo sapiens
ttctatggggctcttcacagaggggccaggtacccctgagcacactgccatgaacttgtgccctctgcttctttccagtcagatcactgactattgactaatgcttacactcaagcgtttgcaagaaattcaaattactggtcctacaataaagtcacatcccttgttcatcgtttaaagcctgcaggttgtattagtctgcttgggcttccataacaaagtaccacagactggtggctttgatggcagaaatttatttctcaaagttctccaggctcgaggtccaagatcaaggtgagagcaggtctggtttcttctgaagccttcctccttgtcttgccgacggccaccttcttgctgtgatctcatatggccttt

SEQ ID NO: 7081 - DNA, 1084 bp, Homo sapiens
caaagaactggcagatgcctgggtgtgtgctggcccacttgccaggtgatcaatggtagtctttgctctcagggtgtaagctttggctgtgtctacagcatgcttcagacacagtgtttctccttggacaattgccccccaataatttaggtatgctgccaccaggtggcagtgatatttcagtgttggcaacttgatctcaattcctgtggctctttgtacccagttttggtgatatttgagaaggcatgctctccttccttttaaaatggcaaagaaacgtaaggtgttttggaggtaccgccagctagccaaattagctgggaaacgtgaatttggatcctggttctgtgggcagattccagaaagtgttcacctaatacagatgcagttactgagtacatgtgagatgccagggctggctaggtcatttctggttcattgtcgttaagcaggtaatagaaccaaggctcagagagatcaagtgacttgcctacagttgcccagcagatttcaatccagatctgtggggctgtcctacctcctccttgatcacaccgtgcttttctctgagattgggactccacagccctcccaggacataacccctctgcttctgctgatacagccactctctctcccctctttatttacaaccacctatttgaggtttttctttttcttttccttccttgtttcttttctcttttctctgtctttaactgaaaaaaaaaaaaaatcagtggaacatcaaaattgaggacctttagaaattccaccacctcagcttgaattttttaactctcttttgtttttattattatactttaagttttagggtacgtgtgcacaacgtgcaggtttgttacatatgtatatatgtgccatgttggtgtgctgcacccattaacttgtcatttaacgttaggtatatctcctaatgctatcttgtttttgtcattttctctcctacaccaatatacatttgtctcctgtggctgcggtgcacatactgtcagaatacgttctcctgtatgtaaagaatgccacttccagcctgggcgaaagtgcgagactccgtctc

SEQ ID NO: 7082 - DNA, 446 bp, Homo sapiens
gctcaaaacaaaacaaaacaaaacaaaaaaacactgaagcactccaagcagtgttaggtagcgcattaaggatattcagagaagtgtccgtgtccctttttgtgtaaatatttatttttattgattttcctcttcttaacattgtgtaaataacttctgtttgaacataattttggaatatctgcacaatagaaagaaattagatgtttgcaaatagacagttgagccctagggatatttggggttctcccttttttaaaatatttgtatttcacagagtgaaataacagaccctggagactcctgaaagtgggatgatgggaggcgggtgaaggatgaaatattacctattggagacaatgttcactgttcaggcgactgggaaagctacaacccagattttaccactgtgcattatatccacgtaatacaactgcacttttacc

SEQ ID NO: 7083 - DNA, 2656 bp, Homo sapiens
  misc_feature (1428)..(1428): n is a, c, g, or t
  misc_feature (1615)..(1615): n is a, c, g, or t
  misc_feature (1750)..(1750): n is a, c, g, or t
  misc_feature (1753)..(1753): n is a, c, g, or t
  misc_feature (1796)..(1796): n is a, c, g, or t
ttagtaattgttttataaatttgggagctccagtcttaggtgcataaatgtttaggattgtgatattttcctgttgccaaggctggagtgcagtggcacgatctcagctcactgcaacctccatctcccaggttcaagcgattctcctgcctcagcctccccgagtagctggaattacaggcgtgggccaccacgcccagctaatttttttttttatttttagtggagatggggtttcaccatggtggccagactgatctcgaactcctgacctcaaatgatccacctgcctcagcctcccaaagtgctgggattacaggcatgggccactgtgtccagccaaataaagtcagttttaatgaacataggttcatggtgtgccataggttaagtttttatacagttggtattaatcaacaggaaattataatgcaaactgcatatactcttaaaaacttttctggaactgagtggatcttgaaaataaaaatgattgttagatatttcaaagattattgtaaatttccaaattctgttttttaattctttacttttaatcataaagtataccatctatttgaaaacaggtataccacaatgtacctacttcatagtgttgctatataatgcgaagaacaatgcttaacacatcgtaagtatgcgatcaatgtcaccattgccttgatttgtttagcacctttaggcacaccaaagaatacagaggtatcatttgagttttctcattcagtataactcatagttctcctccttaaatagattatgttgaggaattaatgagcttctgccagctgaaagcttttgacagatagatgtttgtttcctgggcgatggggccatcacggtgcctaagtcagttacactaccatcttctagccttgaacattctgtgatctattctgaaagatttgacaatttctattctctaattttcttgcctagagtgtgacaggtgcacaataacttttcatttccatgctgcattatagggtaatctttttgaagacattttaaatgacaattagagatctatgtgagttaaaattcaccagtgttatcaatgtgaaaataactgaagtgacaataaaaacatacactatcgtgtttgtcttggtatccaatttgtcagttatcctgaagtaaattttttccacagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtaaatctttacttgtcctatatttttttctagtcagcacttagtagcctcatttatctcatttgagtataataaggttttcactagtataaagaatatttcttttttcttttttcttnagacagggtcttgctctgtcacccaggctggagcgcagtgacgcagtcacacacagctcactgcagcctcaaccaccctggactcaggtgatccttccacctcagcctcccaagtagctgggactatgggcctacaccaccatgcccagctaatttttgtattttttgtagagatgggatttcaccntgttgcccaggctggtctcaaacttctgggctcaagcaatgcacccacctcagcactttgggaggccaaggcagatggatcacgaggtcaggagatcgagaccatcctggctaacacggtgaaaccccgtctctnctnaaaatacaaaaaattagccgggcatggtggcgggtgcctgtantcctagctactcgggatgctgaggcaagagaatggtgtgagcccgggaggcagagcttgcagtgagctgagatcgcgccactgcactccagcctgtgtgacagagcaagactccatctcaaaaaaagaaaagagaaatttggatgttcataactatgggtaaccattctctttagagaagtgcaaacaatatatgcaaatgtaaaacttctttattacctgtctctcctactagtctgtaatctctagaagacagagacttttcatgtcttatttattgctgtattgccagtgtctctcacaatgcttgcctacacatagtaggtgcttgatgaacatgtgctgactaaatgaattaaacccaaatgaagcagggctaatttttctacttgccacaagttaacagcttcttgagataggtggctatttacaagtttgtaatttcttgccatttgtagcatatatgctttgagaatgaatattaattccagttatatacaatgctcatattaggaagggagaagaaactgtcagcaagtaatattgagtgccaatcagttatataaaaatctgggccaggtgcggtggctcacgcctgtaatcccagcactttgggggaccaaggcaggcggattatgaggttgagagttcgagaccatcctggccaacatggtgaaaccccgtctctactgaaaaactgcaaaaattagctgggcgtggtagtgcacgcctgcagtcccagctactcaggaggctgaggctggagaatcgcttgaaccagggaggtggaggttgcagtgagccgagatcacgccactgcactccagcctggtgacagagggagactccatctcaaaaaag

SEQ ID NO: 7084 - DNA, 2380 bp, Homo sapiens
ttagtaattgttttataaatttgggagctccagtcttaggtgcataaatgtttaggattgtgatattttcctgttgccaaggctggagtgcagtggcacgatctcagctcactgcaacctccatctcccaggttcaagcgattctcctgcctcagcctccccgagtagctggaattacaggcgtgggccaccacgcccagctaatttttttttttatttttagtggagatggggtttcaccatggtggccagactgatctcgaactcctgacctcaaatgatccacctgcctcagcctcccaaagtgctgggattacaggcatgggccactgtgtccagccaaataaagtcagttttaatgaacataggttcatggtgtgccataggttaagtttttatacagttggtattaatcaacaggaaattataatgcaaactgcatatactcttaaaaacttttctggaactgagtggatcttgaaaataaaaatgattgttagatatttcaaagattattgtaaatttccaaattctgttttttaattctttacttttaatcataaagtataccatctatttgaaaacaggtataccacaatgtacctacttcatagtgttgctatataatgcgaagaacaatgcttaacacatcgtaagtatgcgatcaatgtcaccattgccttgatttgtttagcacctttaggcacaccaaagaatacagaggtatcatttgagttttctcattcagtataactcatagttctcctccttaaatagattatgttgaggaattaatgagcttctgccagctgaaagcttttgacagatagatgtttgtttcctgggcgatggggccatcacggtgcctaagtcagttacactaccatcttctagccttgaacattctgtgatctattctgaaagatttgacaatttctattctctaattttcttgcctagagtgtgacaggtgcacaataacttttcatttccatgctgcattatagggtaatctttttgaagacattttaaatgacaattagagatctatgtgagttaaaattcaccagtgttatcaatgtgaaaataactgaagtgacaataaaaacatacactatcgtgtttgtcttggtatccaatttgtcagttatcctgaagtaaattttttccacagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaaca

SEQ ID NO: 7085 - DNA, 1134 bp, Homo sapiens
tccttttactgcccatttattaccgtgcgggttaaaaaacgggaaaagaggccgggcgtggtggctcacccctgtaatcctaacacttcaggaggctgaggcaggcggatcatgagctcgtgccgaattcggcacgagaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaaca

SEQ ID NO: 7086 - DNA, 429 bp, Homo sapiens
tcaatagcagcagccagatcaaagcaagtttcaggtaaattggcaatgagatgttcccaaaagagatcaggacatttctcccctagttccatttttccattggtctatgccttatgtttaatggggttcttttcacttttgcaagtagtagtttattatcatgcaatacgtaccttgtccacctatatagtatatagaattcgaattgaccctgttctgcaaatgaagaaaccaagactcagaaaattaagtgattggcctaaagtcatggttgtagagccaagattatgaagactctcatctctagagtttttgcttttgtacctttgtttacgcttttaagagggggcttacggctcatcccgccactcccctccctgccccattgtcttgaaccttttaggaaaggaaggaaccttttaggattct

SEQ ID NO: 7087 - DNA, 2617 bp, Homo sapiens
atacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaaca

SEQ ID NO: 7088 - DNA, 449 bp, Homo sapiens
tacaattcaagatgaaatttggatggggacaaatcatatcagaaagtagtagagttgacagcatggtgaaagatggtgtgtgagacttaaagcttagggaggagtttcatcatagacctagctgatgttgtgtaaggttttttccccctacactgttttgaaaaatgttaaacttatggaagagtggtacaatgaagacccatatacccttcacccaaactcatattcttttctccaaaatgtacgctctctctttctctctatacatgcacacacacacacacacacacacacacacgtgtgcatacttttttactgagctatatgaaattaagttacaaggccaggcacagtggcttatgcctgtaatccgagcactttgggaggccaaggtgggtgaatcacctgaggtcaggagttcgagaccagcctggccaacatggtaaaac

SEQ ID NO: 7089 - DNA, 861 bp, Homo sapiens
agggacctggtgggaggtgattggatcatgggggctgtttccccatgctgttcttgtgatagtgagggagttctcacaagatctgatggttttaaaagtggcagttttccctgcactctctcctgccaccttgtgaagaaggtgcctgcttcccctttgcctttcgtcacaattgtaagttccccgaggttcgtcatgattgtaagtttcctgaggtctccccaaccatgcagaactgtgagtcacttgaaccccttttgtttataaattgcccagtctcaggtagtaccttgatagcagtgtgaaaatggactaatacagtcagggacctaaaagacaggtaaagagatgtggccaggtgaagacggaaaaaggacagtgcattccagacctgtggaaagacgcgaggttggaaagaacatcacaactggggcgactgaagaaattatgttgttaagcacgaaatgcagagagagagctatgtgaatgtgttgagtgtgattttcattaaacaatttttaaagaaagcaaaaaaaaaaaaaaaaaaaaaaaaaaaactttggggggggcttgggccctggaaaagagtttttaaaacctttggtgggggcgcgccgggcacgccagttgtggttacgttgaacagttgggccaagaggggttcccaaagaagagaacccggcggccagagagacaacgggggcgggggtttctcccacccaattaaaaaaggcgccgggggggaaacccagaggtggtcctggaacaaattttcgcaagatgggggggtcccaggaggggcacatacgcggggtctctatcaccggggggtgcccagggagacgtcgatacttcaattac

SEQ ID NO: 7090 - DNA, 318 bp, Homo sapiens
acaggtactccttcaaccttacaaaaagcatctaaaaagccccacagctgacagcactctttttcaacatagttctggaagttctacagagacataatacaagaaaaggaaattaagacaacagatgagaggaaagaaataaaactgtccctttttgctggtgacatgatcatctacgtagaaagccccagggaatcttgagtctgctgctgacatgattgtccaaacagaaaatcccagggaagaggcggagcttgcagtgagctgagattgcaccactgcactccagcctgggcgacagtgtgagactctgtctca

SEQ ID NO: 7091 - DNA, 363 bp, Homo sapiens
ctatattgaagttatttgtaccaaccttttattttaattagattattttctgtctagtaccatacagttttaataattatgttataccatttgtttaatgattctagtattctttttgtatagaatttcccttcacttttttcatatatttaattcccagatagaaattagaatcactataagtttcagaaaaaaatcatattggaattttaatggtaatgtgctgaatttatagattaatttgtgaaaagttaacaacttgaactgatttaatattcccatccagaaacaggtctgttcatttatcaaaagtggaaaaaaatttctttactttcaagtcttgtgtatgttttaatacactcc

SEQ ID NO: 7092 - DNA, 424 bp, Homo sapiens
gcaatagaatgcaggccaattcatgtggagctttgtaagccacagccaagactttggaaaggcactagacatttttaagcatataaaaagatgtgccatgtttttattactggcagctatggaaagaaaagtccatagagaagaaaggatattagggggagaagatagaaagtttttatagtagtccaggtaagtggcttgggccagtatggtagcaatcgttgaacgaggtaatgagaagtggaaagattatgaatggttttgaagttagagctgagaggttttactaatgtgtttgacagtagatgtaagagaaagagattaaattttttgtcttgagcagttgcaagaatggagttttcatatactgagatatggggaagactgaataaggaacagatttttttttgtaggagggggacag

SEQ ID NO: 7093 - DNA, 512 bp, Homo sapiens
attcgcggccgcgtcgactttttttttttgagatggagtcttgctctgttgcccaggctggagtgagattctgtgtctacataaataaaagaaaacaaaaatctgacaaacgtacatatttcttattgtattgatgacatctataagtttttctcttggtctcgatatagtatggttgtgctcactctgtaatttatagactagttttagagaagaagatacaaactgttcttgaaactgagttgacaaatattgttcaattatacaatgtttttatttaattataactgagctacctccacaagactccaagtcagagctttggtgaggaacacccagaaaccaagtcttgctgaatagtgtgaaggaaggcaatatgcggtaagtgagctttcagcttgaaattatctgtcaaatcctaagttcaatgaaaagcatcaaaatgtcaagctcaagatatgaacttgaatcagttaaaacctggaaatgttagtgaatgtttcgcacaccca

SEQ ID NO: 7094 - DNA, 294 bp, Homo sapiens
gttgtcacaactggaaacatgttactggcatctggcaggtagaaaccaaagatactattaaatatttgacaatgcataagacagcctcacaacaatgtggcccaaaatgtcaatagtgccaaggttaggaaacctgaaactacagtaatcaagacaatatacgacgggcgcagtgcctcatgcccgtaatcccagcactttgggaagccgaggcgggcggatcagctgaggtcaagagttcaagaccagcctggccaacatggtggcaggaggctgcagtgagccaagatcaag

SEQ ID NO: 7095 - DNA, 432 bp, Homo sapiens
gcagtgtagaacaggaagcatgcatgcttttgggggcagctagccaccttgtgacagctgtttactaactgcagagcttatgtgctcttggatgggttacttctcttctctaggactcatcttctcaaaagttaagtcaggaaagataatcatatctccctcattggcttattggaagactaagtgagacagttcataaaatgcatcgagcacattattagcacttagtaagatttcaggaagtgtcagcggctattattaatatctaagtctttattttgggattctgacattacaatttactttttaaaaatggccagcattgtttttacttcatttatccaggtacatatgaatgtcttgttttcctgaataagactttagcttttcaagaaatgcacagtgcaaagattgagaaagtttgaaatagag

SEQ ID NO: 7096 - DNA, 403 bp, Homo sapiens
aggggaaggggtccaaaataccagtattgtcaccatgatcgattataggttacctcagaaatttgcctggcttccccattcacattggcattactattttacttcatttagagtcctgtttcttttgttaattacagaataaaatttacatttgtaggtttttccttatccttctctttctaatgcatatcgaaagccctgttcagattttcatgaattttgtaattttggccatacacgatttggtatgtcttaggttgatattttattagctgacacaagttaatatttctttagaaggtgatggaagaaaacagcagtattttttccaatatatttcctctaaaatacattaggaagaacagttttgaagtggtgaatagtttttggagacaaaaattct

SEQ ID NO: 7097 - DNA, 941 bp, Homo sapiens
tgtgagaaggcaagagggagttgagtaattgtcctttccccaggtctacaaagctcctgcgaagtagtttttcttagcaggtgggcctttgttatggagaatgctctgagcaattgcaaaatggttactttcccctctccctgcctaaaatacgaggggatttttttctttgatgttcttgtaagaacctgttcaggctcctggaggtaaaagctatataggtccctcttaagtctggacctccagaagttttaactctcaagctagtccacactcagtcttctgcagttcgtcaaaattaccgttcaggtattgattactgtattgcttactggttcatgtagcttttgcttctggtaatctgatcttttctgtgattctctgtattttcttgtgatttttttccttcaaattttgtggtagctgtttgctctgtgaccccagttctctaatggatctaagaaaggccattgatttcagtttgtttagctgttttcttgctgtgaggatgggaatgatgacttctgaactgaaaatgaagcctggcacccaacaccccttgctttaacaaatccctccaggtgattctgaggcatgtgaatggttgagaaccactcatgcagcgttagtccttcagttcacagataaagtacaaaggggaaactggctggtcactgtggctcacacctgtaatcttagccctttgggagcctgggaggtagatggtgcagtgagctgtgattgcaccactgtacaccagcctgggtgacagaacaagactctgtctcaaaaaacaaaaccagagtgctgggattgcaggcgggatccaccatgcctggccagaacaaatgcctttttaaaccttttaagaacattttttaaatgtctttttctatgtcaaatgtaacgtttatttttttaaacaataaaattgatttgcc

SEQ ID NO: 7098 - DNA, 557 bp, Homo sapiens
gtcccagatctcttaccctctaaccagttcctgcctgggagctgcagtgttagagcatatgcaaagccctaattgggggagagctgttcggtggacagtgaacggaggtgatgtggcaagtataatcactcccttcagctgactgtcacggggcagagccgcccagcccagccctgtgtgtggctctggctcaggttttccaccttgcatcagtgcagtggagttcgtggtcactcagcagtgaatgcatccaaccacgctactaacgcacggcactgctgatttatacttaatttaagcaactgctacttggaaccgaagtccagatttgaacctccgtgctgaaggcatcaaattgccggcaagataacagctccagaggagacttctcccactcccccaggttttacgcaatgaggcagtccacccaaacttaacgtgggctgcaggctgtaacagcaggttgcttttgtgttcattaaactgcatgaatgggtttgaacatgcccaaagccttgctaatgcagacttaattttgtaaaattaactatgccttt

SEQ ID NO: 7099 - DNA, 565 bp, Homo sapiens
atatgggcagtgctgataattggttcatttagtaacagtagcctccggatgagaactagatgagagaagcttattaattgaaatggtttccaaaaaggattatttcacttacaagttgaaacatggtgtgtttcccctactgaatcagtattctagtgaaacatacacaatattgtatgcatgagaaaaatcattttattggcatctggccaacaattgtctaattcctatgctatacaatttatcataattttgctatcagagaaggagtgcatgtaaaattattttgccttatatccttttttaaaaaattactatagtagcagctccttatgtcactctaaattttatttactccttatctgtcattcgatatttcagtagatctttatgtgatagtaaaagaattgtgagccaggctttgtggtgtgcacctgtaatcccagctacttgggaggctgaggtagaaggatcgcttgagtccaggagttcaaggctgcagtgagtcatggttgtggcactgcacagcagtgggcaacagaaggagaccctgctcaaaaaaaaa

SEQ ID NO: 7100 - DNA, 569 bp, Homo sapiens
ttttgggtgccttttttttttttttaacaaaagcaagaaatgcccaccataatagcaatgtatggttctgatttgcctaacatctgacaacttataaagccatcagcaatttattgatatatagctacatgtcccctgatatacccatgaacgactgagggtcacttccttatttgctctactgctgtttctaggctattcttagaactgtaatctgcagggaatttcctatgctctgaaaatgtctaagatctgcccttattaaatgctacattttcatcaaacttaaaaattaggcacaggttcttagttttaaaaaaacaaacaaacattgcaccattaggaacttctgtactttaaatattgccattgtgtttggaaaatcatcttcattgtcttgtctaataattggtttccaagtgactactcaaagagtgaatttatcttcaatgtcaaatattccgacattggacttgatgattttgaatttgtttgcagtgttagatgactccaaacaaacacaaaaactctgtacaggagaaaaactgtctcaacatcagttttctgtt

SEQ ID NO: 7101 - DNA, 478 bp, Homo sapiens
actctctcccattaaactggtgctttttttacgaaattgtatttattctgtaatcgttaagaatttcttatcttttctattataacaccctggctttgcagtgctgagcagtgataatttaacttaaaaatttattgaaactgtgatgtacaaaggtttaacaaaaggatattacttttctagtttattccaaaactggggccagctatggtggctcactcctgtaatcctagcactgagcctgaggcgggtggatcacttgaggtcaggagtttgagaccagcctgaccaacatggtgaaaccccacctctactaaaaatacaaaaattgctgggcatggtggctggcacctataatcccagctactcgggaggctggggcagagaaactcttgaacccgggaggcagaggttgcagtgagccgagactgtgccattgtactccagcctgggcagcaagagtgaaattccatctcaa

SEQ ID NO: 7102 - DNA, 467 bp, Homo sapiens
gcagccgcctactactactaaatttgcggccggtcgactgaacccgggaggcggacgttgtagtatgctgagatcgcgccactgcactctagcctgggttcacgccattctcctgtctcagcctcccaagtagctgggactacaggcgcctgccaccacacctggctaattttttgtacttttagtagagacgaggtttcaccatgttagccaggatggtcttgatctcctgacctcgtgatccgccagcatcagcctcccaaagtgctgggattacaggcgtgagccaccgtgcccggcccataaagtatacttttaagtgttgatatacagacacctgtgaaaccattaccacaatcaaaatagcaaatgtatgcatcaccccaagtttccttgtgccccttcctaatccttcctcacacacttcctctctaccatcccccactcccatctgcttggaaagtttt

SEQ ID NO: 7103 - DNA, 767 bp, Homo sapiens
gttcctctctctgcgccttggctccccttcccagagcccttcctcttggtcttgccaaatcctgcccatcctttgagaaacgcttatgcccatggctgtcttaccccttcctgctttgctgtggtatccattagtctgttctcgcgctgctaataaagacatacaaaagactgggtaatttataaaggaaagaggtttaatggactcacatttccacatggctggggaggcctcacaatcatggtggaagatgaaggaagagcaaagggactttttatgtggcggcaggaaagagagcttgtgcagggaaactcccatttataaaactgtcagatctcatgagacttattcactaccatgggaacagtatgggggaaactgcccccatgattcaattatctccacctggccctgcccttgacacgtgggggttattacaattcaaggtgagatttgggtggggacacagccaaaatatatctggcatatgcaatctgatcaccccttccaaacttctctcttaaaaatgcaacattctgacagcatgtggaggcttggatggaaacacggtaaaaattacaacattgtttctcacacttttgcaccaaagtgatacaaatcgcagagctgaggcaactggtgtttctgcgagaatggaatggaatgtggttgaaattttgtgttgttttttaaatatttgcaactatttgtcattcttccataaaaatcagaattcatggttgtgtacataaaagtaattttctaaa

SEQ ID NO: 7104 - DNA, 398 bp, Homo sapiens
cggacacggtagggtgctccatgccacagggcctttgaacaaacctttcttatccttggaataaatgccttttcttccttttgttcccctgccaaacacatgctattaggaaagattcaaccccatgtcatcacctccacaaagttctctcttaaaaatgcaacattctgacagcatgtggaggcttggatggaaacacggtaaaaattacaacattgtttctcacacttttgcaccaaagtgatacaaatcgcagagctgaggcaactggtgtttctgcgagaatggaatggaatgtggttgaaattttgtgttgttttttaaatatttgcaactatttgtcattcttccataaaaatcagaattcatggttgtgtacataaaagtaattttctaaa

SEQ ID NO: 7105 - DNA, 401 bp, Homo sapiens
tacactgactgtgtctcccacatttagcctaccaccttacctctcaaaacaattgttaccaggtacccaaattgtctttctcccagtcattatcagtgtgtaaagatcatctgagaagtgataaaagggagtctttaaaaactttaagttttccactttgggaggccaaggcgggtggaacatttgaggtcaggagttcaagaccagcctgggcaacatggtgaaactctgtctctactaaaaatacaaaaataagccgggcgtggtggagagcacccaaaatcccagctactcaggaggctgaggcaagagactcgcttgaacctgggaggcagagattacagtgagctgagatcgtgccactgcacttcagcctgggggatagagtgagattccattta

SEQ ID NO: 7106 - DNA, 388 bp, Homo sapiens
gctgtgacagtttctcagaattttcttgttttttgtattcgatctgtttactgactctcgttttgccttttctagaatgtcatataattggaaatgtacagtatgtagctttttcagactggcttttttcacttaacactatgcatttaagattcatctgtgacttgtcctggtttaatggctcattttcttttttggtgggcgggtggagagacagggtctcactctctcacccaggctggagtgcagtggggcaatctaggctcactgtagctagcctccacttccctggctcaagcaagcctctcacctcagcctcccgagtagctgggagactacaggtgctcgccaccatgcccggccagtgttttaaaaaaactttttgtaa

SEQ ID NO: 7107 - DNA, 243 bp, Homo sapiens
cactgtctagggctcaggcgtgggtaagagcatacctagcatttgtgtaagagaagtataaacatacaatatggtccagtactgggttcagcataaatgtgaggttaagagataaagctaggctgggcatggtgacttacacttgtaattccaacactgtgggaggctgaagtgggaggattgcttcagtccaggagtttgaggccagcctgggcaatacaccaagatcctgtctctaaaaaa

SEQ ID NO: 7108 - DNA, 1001 bp, Homo sapiens
tctgttcacccctagcttagccttatgacctgggctgtccttccccagaagctgtctggcccctttgagagacaatgtcttcccctagccacaggttcaaccaagtcatccattggcatctatactccaggtcttaaaattgtggattaagggtggcctcacccttaatctcctctatgctatctcctctaatctccccgctctctgggagataggtcctgttgttatcttcattttacagatgaggaaataggttcagagaggggaaatgtcttgcccaaggtcacacagctggtgtgtgggatgggttcccaggctgttggtttcttcagcctctgccatttccagtgcatcacatattcctgtttgatgggggtcaaagcaaagaagattcttcctgactagagtcaggagatcaggccctgattctgtcattccctggccctctgtcctcagcaattgatgacataaatgttgattgtgtctttgcaatgcacgtggtatcaagggctttacatccttgttccccacggcatccaccatgatcttaagacacatcctagtcctgtctccacttcagaaagaaagcaagaggcacgtgaatgttgagccgtgtgacagagtcacaactagaccccgaggtctgctggattccagagaccaagttctgtgcgggtgtgtgatttgaacaggtttataaaaggcacccaacttttaaaaaatccaaaatgtgtccccaaaagataaaacattctcttgaatttccctcctcagaaacaaacctgtcaccaattttattgtgtcattccacgaattttctatgcgtggaatgtacacgtatacgcgtgtgtacatatatacatctatatccgtttcgctatcagcaactacacagttcttcagtgtaccgttttcacttaatttaactgagaggttcttccctgtcacacacagatgtgcgttgtttccttgaacaatgggatagcattccactgtaaaga

SEQ ID NO: 7109 - DNA, 492 bp, Homo sapiens
gcagccgcctactactactaaatttgcggccggtcgacgaaaagcacagcacaaaagtcccacacctgttcctgataaagactctcacaacccaggaacagaaggggaagtccccagctggaaaaggccatctgtgttaggttccagttgctgctgggataggtcaccgccacctcagtgatttaaaacaacacaagtttaggccaggtatggctcacacctgtcatcccaacactttgggatgctgaggcgggtgaatcacttgaggtcaggagttcacgacaagcctggccaacatggcgaaaccccatctctactaaaaatacaaaaattatccaggtgtggtggcacgtgcctgtaatcccagctacttgggaggctgagaccagagaagtgcctgaacccaggaggtggaggttgcagtgacccaagatcgtgccactgcacttccagcctgggtgacagagcaatactccatctcaaaaaaaaaaa

SEQ ID NO: 7110 - DNA, 427 bp, Homo sapiens
cgattggggaatacctggaacaagatgaggagcagccaaccccatcaggctttgaacccactgtcaaccccagctctggtataagcaagatggagctgctggcctgctttagtgtgagtgctctgccagagggaaagctcctagaacagtgagaaggccctccaggggaattcctcgaatactcagaggcagtagtgtggggtagtagttgaagcacacagctctagagtcagacaggcttggattcatatcttggttctgtgaccagccttgaatgagttatttaacttctctgagcaatatttttctcgtctcatttataaactagggatgataatggtatatgagataatacatgctgtgggcttagcacagtgcatgatacacaaacatgcaataaatattaccttgttattcttttgggctc

SEQ ID NO: 7111 - DNA, 370 bp, Homo sapiens
cagacatcttttggggctgcttcttggagaatgagactctgtgggctgagcgactgtgtggggaggcaagtctacaggctgtgccccccagcaaccaggcttgggtccagcatgtgtgccagggccccaccccagtagtgtggggtagtagttgaagcacacagctctagagtcagacaggcttggattcatatcttggttctgtgaccagccttgaatgagttatttaacttctctgagcaatatttttctcgtctcatttataaactagggatgataatggtatatgagataatacatgctgtgggcttagcacagtgcatgatacacaaacatgcaataaatattaccttgttattcttttgggctc

SEQ ID NO: 7112 - DNA, 3693 bp, Homo sapiens
gagcgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaactg

SEQ ID NO: 7113 - DNA, 2752 bp, Homo sapiens
gagcgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccagagcttcctgtcagtaaccatgttttcaataaatactctttcatgtacaaactg

SEQ ID NO: 7114 - DNA, 1942 bp, Homo sapiens
agtcgggtaccgagtgggtcagtgtcttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaactg

SEQ ID NO: 7115 - DNA, 1299 bp, Homo sapiens
gagcgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatgtgagttcctggaacatgctgtattttattactattaacaacaattattactgttattgttaatatattattattgaaattattaatgagtgaggaggacacacagaggaaccttatcaataggtaaatacctcttgaactgaatagctttttcccgcgatcttctgtgagcagagttgcctctaggcagccatctcaccagcaattgcagtgcgtccagggagggaccaaggccagctctactgtttgttgccctgcaactccagaatttttatccagagggaatatgttaaaataggcacaaagggggaaaataactcatccaactgacactgattaaaaa

SEQ ID NO: 7116 - DNA, 274 bp, Homo sapiens
atgtacacaaaggactacaaaatgctgggatttaccgtaagtacctcagagcatagacggtggtaggccctctcccctgatgggaagtcaatggtcccacccagacagagctctgacaaccagccccatggtggccctggaatagatgacagttaggaagctggtggagctttaatgcttgctttgctttgttgatggtgagtctgtgagtttatgtgcaaagtttggccctgtgaaacgaatccatctgtaggggggttgcggtcagctagag

SEQ ID NO: 7117 - DNA, 3625 bp, Homo sapiens
gagcgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaactg

SEQ ID NO: 7118 - DNA, 2648 bp, Homo sapiens
  misc_feature (2611)..(2612): n is a, c, g, or t
gagcgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgacggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatggcccccagccgtatctttgtcttaaaaagtaatctctnngcttggtaggccaagaatttaaaatataaaaaattt

SEQ ID NO: 7119 - DNA, 1723 bp, Homo sapiens
gagcgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccat

SEQ ID NO: 7120 - DNA, 361 bp, Homo sapiens
cctgggatagatcatttcttaacatctcccacacctctgtgtaacaaaattactattgatgatagccatgaaatgaaactaataatattagcttgtgaacatttaatcaaattttttatgtataatcatgccagtaaaaacttaaaaaataaatgtcaatccattgccttaagcatttattaacccttccattactaactcttgctcattcacgcacattttacttgaaaaaagacaactagtctgggcactgtggctcacaccagtaatcccagttctttgggaggccaaggaaggatgatcacttgagtccaggagtttgagaccagcctaggcaatagagtgagacttcatttctacc

SEQ ID NO: 7121 - DNA, 423 bp, Homo sapiens
tttttttttttaattctgggctgcccccttcttctttctgcaagggtctgaggcctattgttggatccaggcacagccttctaaggtaaactattttattttgcttttgatctcacatcttctgatttcatgacttgtttttcagttttcattttcaagttttcccttctgtgtccttctatttttttacaaacgggctgggatcctgctccatataaaaagggaggaagaaaaggatcctccttaatcacctgaggctggcctttgctttaccaccaaagtctttaaattacttggtggcatggtgatatgtggagaaacaagcctatagttggagttcctgggtttaaaacctggctatgatttgaatgtgtcctcttcaaaagtgcagcactgccaatatgatagtattgaggtcgacgg

SEQ ID NO: 7122 - DNA, 1077 bp, Homo sapiens
tgatcctagtttttagtgtcaagttatagtaacctcataaaatgaattggagatgttaacatttattcaagtacataaaactggagttacctagttcttaaattttggggcgaactgtcctggtaaaatatccagacctggtgctttcttttttaaccagtggtttaaattctttaataatctattcagggtttatatttattcttagctcacattaacaatttatatttttctatgaatttttctatttcaccttagttttcaaatttattggcacgaagttgttcttaatagtcttttattttaatttccacctaatttaattatgtcttttttcattactaatacttctattcctgatctaattacgtctttttttcattactaatacttctattcctaatatttctcttcatctttttttccctctttatcacaaattactgcatacctatcattaacaagctgttaagccaaaataagcaagaaaccattagtctggggttgtttctgtactaggaacccttacataaataagcaaaccaaaacttaacttagaggcattccttgtgactgattaattttgaatggagcttcagccaatcgcagataaccaactagcaaattcgttatattaactagggactttctattgaaccatatccaaataaggcaaatgcctagctataaccaatcaagtaatttctttactttgcctccacattcagcctatgaaagccccctgcccatactgctggaacggagctctcagaatctcttgtggatttgagtgttgcctgattcatgaattgttatttgctcaaataaactgttatatttattttgtctaaagtttttcttttaacaaagtcaagtgggagaaggcaaggatcatcagtagccataggactaacaagagagagagatattcaagggacactttagagatgaaaatcagagacaggcttggttgtcaatgaaacgtgttcagagaagactgatgacaatgacaattttttttaactttgttgactacatgagtggtagcttcctaaggtatagagagggtaggtaggc

SEQ ID NO: 7123 - DNA, 3848 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaa

SEQ ID NO: 7124 - DNA, 3996 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtttttgccttttccctagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccaggggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaa

SEQ ID NO: 7125 - DNA, 3087 bp, Homo sapiens
ggaggataaggctagtagagccgtgttatcggacgagcccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccaggggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaa

SEQ ID NO: 7126 - DNA, 1249 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtttttgccttttccctagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgcgataacgggaagcatgagaagagaatgaacg

SEQ ID NO: 7127 - DNA, 861 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggtaaatatactttgcttagttttttttttgcgattggccttacgtataagtaaaaaacgtacacacagctttaaaaaacgtgctcttggtagtttttaaaggggcttttgtttgttttgttagtggagatacatagtttagaaagctactttttttttttttactttcattatataaggtgtttact

SEQ ID NO: 7128 - DNA, 493 bp, Homo sapiens
aacttgtttgtgatttttttattttttgggcattttatttttcccgttgaaaacaaaatttctcttttcttctcatgggtcagtttgcaggatttgagcatatacaacccggaaagaaccatcactgtgaagggcacagttgaggcctgtgccagtgctgagatagagattatgaagaagctgcgtgaggcctttgaaaatgatatgctggctgttaacgtaagtccctaatgctttcttctccgctggttttcactaggctaaaaatacttgccattcagctaatgaggaagtgccttaggataggtatgcagagtttttcctgacttcctaggataaaagcattaaaataatcaggaaaccaactagtaaattatgataagtgcgctggacaacatcacgtgaagacattaaaattataactttgaagactgaaataaggaaaagcttatgatatagtgtttattaagaaaagcaagaataaaaaaaaaaa

SEQ ID NO: 7129 - DNA, 3978 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaaccaacaagccaatctgatcccaggggttgaacctcagcgcacttggcatcttttcaacaggactgtccgtgctatctccaccagcagggccccgcggagctccccccgctgccccctaccaccccttcactacccactccggatacttctccagcctgtacccccatcaccagtttggcccgttcccgcatcatcactcttatccagagcaggagattgtgaatctcttcatcccaacccaggctgtgggcgccatcatcgggaagaagggggcacacatcaaacagctggcgagattcgccggagcctctatcaagattgcccctgcggaaggcccagacgtcagcgaaaggatggtcatcatcaccgggccaccggaagcccagttcaaggcccagggacggatctttgggaaactgaaagaggaaaacttctttaaccccaaagaagaagtgaagctggaagcgcatatcagagtgccctcttccacagctggccgggtgattggcaaaggtggcaagaccgtgaacgaactgcagaacttaaccagtgcagaagtcatcgtgcctcgtgaccaaacgccagatgaaaatgaggaagtgatcgtcagaattatcgggcacttctttgctagccagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaa

SEQ ID NO: 7130 - DNA, 1776 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagtcaacacagacacagaaaccgccgttgtcaacgtcacatatgcaacaagagaagaagcaaaaatagccatggagaagctaagcgggcatcagtttgagaactactccttcaagatttcctacatcccggatgaagaggtgagctccccttcgccccctcagcgagcccagcgtggggaccactcttcccgggagcaaggccacgcccctgggggcacttctcaggccagacagattgatttcccgctgcggatcctggtccccacccagtttgttggtgccatcatcggaaaggagggcttgaccataaagaacatcactaagcagacccagtcccgggtagatatccatagaaaagagaactctggagctgcagagaagcctgtcaccatccatgccaccccagaggggacttctgaagcatgccgcatgattcttgaaatcatgcagaaagaggcagatgagaccaaactagccgaagagattcctctgaaaatcttggcacacaatggcttggttggaagactgattggaaaagaaggcagaaatttgaagaaaattgaacatgaaacagggaccaagataacaatctcatctttgcaggatttgagcatatacaacccggaaagaaccatcactgtgaagggcacagttgaggcctgtgccagtgctgagatagagattatgaagaagctgcgtgaggcctttgaaaatgatatgctggctgttaacgtaagtccctaatgctttcttctccgctggttttcactaggctaaaaatacttgccattcagctaatgaggaagtgccttaggataggtatgcagagtttttcctgacttcctaggataaaagcattaaaataatcaggaaaccaactagtaaattatgataagtgcgctggacaacatcacgtgaagacattaaaattataactttgaagactgaaataaggaaaagcttatgatatagtgtttattaagaaaagcaagaataaaaaaa

SEQ ID NO: 7131 - DNA, 972 bp, Homo sapiens
tatatcatgtaagctagtcacacctatttgaattcacttttctttgtttcttgatttcttatggctattattgcaacaatcaaacaaattttgaataccttttgtgagctagcactgtggaaatatgagggaagtttattgtgttcttactttaaatagtttgcagttttattgtgtatacaaatgtatgcatgtgaaatatacagattttaaaaaagcagatcattaaagattaggtcataaggtgtagtctgtacatggaggaagagctaagttgattcagaataacatggttagatttcgaagctagcctggatttgaatcttggatccaccactgactagctatgtaagcttagtcaagcaactcaacggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaaggtaataagtgaggaagccttttgggttttggagagagatattatctgttatttcttataggttaggtcaactccagggagaaatagtaagttcatatttctttgaaataagcttcctagagtatatgtatttacatctatgtaagatgtatcttacatagatgtgagagatatctgtctctttctatgtatgtctat

SEQ ID NO: 7132 - DNA, 214 bp, Homo sapiens
gaatctcttcatcccaacccaggctgtgggcgccatcatcgggaagaagggggcacacatcaaacagctggcgagattcgccggagcctctatcaaggtgaggctgctcctgacggccctgtggcccttctaccacctcctctcatcccacggcccttgttccctctcagtcccaggcagcgccacaccatgcagagacagagtcccacagaga

SEQ ID NO: 7133 - DNA, 361 bp, Homo sapiens
gctgaggcaggagaattgcttgaactcaggaggcggagattgcagtgggccaagatcgcgccattgcactccagcctgggcaacaagagtgaaactctgtctcaaaaaaatacataaataaaacaaaatatactctatgaacacctactttgctgtcgtcgtagacaagcgctgtccaatagaattttctgggtcatttttttcctttcttttaaacatttcaaatgtttgtacaaagtatagactttggatttagtagaacaaaaaaatgtgttttgctaaacatttttgtttttatgagcaagtttctaatttataagaattgaaaagattttttaaatttcttttgagatttttgtaa

SEQ ID NO: 7134 - DNA, 243 bp, Homo sapiens
attcctaaaaaaagaacttcaggtttagatagtttccctggagaattctatataacatttaaggaggaaataatattaatcctacacggactctttcagaaaacataggaggtaaaaacaaaacacttcctgatttatgagacaggcataatcccaacagcaaaacctgacagatattacaggaaaataaaagtataggccaatattcctcatggttctaggcacaataatctttaacaaaat

SEQ ID NO: 7135 - DNA, 512 bp, Homo sapiens
atctttgacagcatttggtgtgttcacctttttgaattttagccattctaaacagcttatctgcccctactgtggaatgatgtgacagacatagaataacacttacagtgattctagttcaaaatgaggcaacatggaagggataaagaagtcactgacccaaaatagtttggaaatggagctgggcaaaatccagcagaagtttcttaattaggatcgacagcctgggaccggcccgccgtcctgtgggtctttgcctctgggctgtctgctgtgcatttcttggaaccattattatttatctttttttctcgcacttttttgggtatggcttctatcgcactccaaatgtttttgagattcatccatgttgttctgtgtgtcaccagtttgttcctttagccattccatggaatgagtgtatcacagtttattgatccattcttgtattgacagatacttgaatgtttccagttttttgtattatgaataaaactgctatgaacattatt

SEQ ID NO: 7136 - DNA, 395 bp, Homo sapiens
agtatcttcactatgcaacaccagacagccatattatgaagaaattaagtggaaattagcagaaatatccattcatttgctgtactatttgtatgccatagttttagaagtttcaatagcacacacttttttgggtatggcttctatcgcactccaaatgtttttgagattcatccatgttgttctgtgtgtcaccagtttgttcctttagccattccatggaatgagtgtatggaacaatgccaccgtgaatggaatagtttggggaaagcttggccaaacacaaccctgatttcagagcaggaacatggtttggatagatcttcagttccgcttgaattattctgttactgcgctgtcattttcagaagatttccattccttggggtaccgag

SEQ ID NO: 7137 - DNA, 401 bp, Homo sapiens
tacattcctctagaaaagtttttcctgaccccttaactcttagctgggagaacccccagtcaattggctccgcagatctctctgcttatctgtgagagtacttagctccttgcaaatatctacatttcctgttccttattcactgttatatccataaagccttacacagtgcctggcccatgtttcctgagttgaaccttgccttctcagtgctgttaaacaagcacatcacctctaaagtcaaaatcccaagagtccttcaggcctatttctgagtgggagagaggattatcagaatattagcctttggctggaggtggtggttcatgcctataatgccagcagaggcaggaggatcatttgagcccagccaaggcaacattagtgagaccccgtctctt

SEQ ID NO: 7138 - DNA, 282 bp, Homo sapiens
gtggcattacgtcataggccaaaatattagtaatttttcaattagtacaaaaaaatgcaggagagttcaaaattattgaagacagtgagagtcagagggggcagcaattttttttttaaatagtttgaaaaaaaggaagaggctgggtgtggtggctcatgccagtaatctcagcactttgggaggctgaggcgggagggtcacttgagcccaggaaattgaggatgtgttgagccatgattgcaatattgcactccagccggggtaacagaatgagaccct

SEQ ID NO: 7139 - DNA, 505 bp, Homo sapiens
tccccagctcaggtttcgtcacctacgcaccctcctgaaaggcttaacactcaagccgcatgctggagttgaaatccctcagcattgccttgcaaggctgccctcttccttgttcccccatgtgggaaaagagaagcaaccgtttcagaactatggtggatgctttttgcagatgagtggacctggggtgcattctgtatcctcgaatagaaataagctaactggccaggcgcggtggctcatgcctgtaatcccagcactttgggaggccaaggcgggtggatcacctgaggttgggagttcgagaccagcctggccaacatggagaaaccccatctctactaaaaatacaaaattagccaggtgtggtgtcgggcgcctgtaatcccacctactcgggaggctgaggcaggagaatcgcttgaacccgggagacggaggttgcagtgagctgagatcatgccattgcactccaggctgggtgacaagggcgagactccatctc

SEQ ID NO: 7140 - DNA, 198 bp, Homo sapiens
caattcaaaaggaacaaataattatttcagtgtagactgtcacagaatctagggcatcatcaaactttgatccctttgggctttttacttggaaagaatgcagtttctctttttttttaaccttagctttattctccaaacattttaaaatttaattcatgggctattattttgttcataagctaagtggcttaccca

SEQ ID NO: 7141 - DNA, 658 bp, Homo sapiens
taaattttttcttcattagcccttgtttgtatacaagtcactgttcaatgttagacaccaaggaactatttaaaacaaacaagagaccttaggccagttttaccactaaccagcaaatcttctgctatcttttggttgaatttccttgattataaaatgagaaaaatcgggctatatgacctggatggttcttaaaactctagtattctattaaatataactaattaccatcaaattgcattgtatttgttcccggtttggaattgaaacgtactaattgctctctactcagtttctcactgagctaactttaaatgttcctttgaagcattgtactatgataattttgttcttcctgttgctagtggcagttgtgccaggaaaatttgactctgtctcaagaattaacccattgtaaacgctgtgtggttcctttcctctcactctcttaatatcagctaggctttatcatactttatttggaaagcttgagaaagcagccatttccctgtagagctacagcttaatttgacaatttgtaaaccatttgttctttctactttttgtaaggttatttccttgggaaactatttgacataaaataactattttgctgaattttgtaaaataaattatttgccaaaacagtttttcttca

SEQ ID NO: 7142 - DNA, 298 bp, Homo sapiens
ataaggccagagctgtgcttaattagtcctggaggcacaagaaaaaatgttaaatttattccattgattccaagcaaaagatacttaaacttatccaggggctagggcattagaagagaggcagttttagagaactctttctccttatgtaccctaatgtttgatattttgttatttaatagttattgaacatttgttgcatatcagacactgtgctgtgttctgcatgcatttcctgttctttgattttcctacacgtgaggaaactgagagttagagaagttaactaacttgccaa

SEQ ID NO: 7143 - DNA, 485 bp, Homo sapiens
ggatgtggctgaaatgagattgtcagcaaattacaacttcaagcctaggactgcagtgttatggattgcacctcatccttggttattgaagatatattcaaaatttatgaaaaatagaaaaaccttattacttctgaatttttccacgttagactttccttatacttttaagatagtgaaagtgttattatataagatcatggaaagtttgtctttccagacctattttatgttaggattttacaatattaaattcataagataatagtagagactagaaaacaaatccttactgataatgaatttcctaagtagtaaatacaaatgaatatttatttgtaaacctgggtgattaagtaatagctgttcagtgatattgatggaaggaaattaatattatttaatccaaaggccaggcgtagtgactcacacctgtaatcccagcgctttgagaggccgaggcagatagatcgtttaagctcagg

SEQ ID NO: 7144 - DNA, 403 bp, Homo sapiens
gattttctttttccttttgctctctgaaatgacagtttactacatggtattgctgctgtcatttttctgtcattatagggaaatgccatatatttgtagcactttcgtaaagtgttgaagtaggccaggcatggtggctcacgcctgtaattccatcactttgggaggcagaggtgggtggatcatctgaggtcaggacttcaagaccagcctgatcaacatggtgaaaccctatctctaccaaaaatacaaaaattagcctggcgtggtggcgggcacccgtagtcccagctaccaggaggctaaggcaaggagaatcgcatgaacccgggaggtggaggttgcagtgggctgagattgcgccaccgcactccagcctgggcaacagagctagaatgcatct

SEQ ID NO: 7145 - DNA, 418 bp, Homo sapiens
tacacattgtatatataaatagtaggctaagcttatagcactttttaaaacttattattatgggaaaaaatttaaatatatacaaaaataatagaaagaatggacctctgtgtatccatccccctaggtcaagtattatcaatttacagccatcttttgaatctattctcccaccccactatcctcatggcttagtttgaaacaatacccagacgttatagcatttatctgtaaacgtttcggtatccatttcctaaatccactaaaccattattatacattaaaaaactaacaataattccttaatttcatcaaatattcattattcaaatgtacttgattgtctcatgtttttttgaaacaacatgtttgaatcaagatctaaataaataaaacacattgtaattggttgatatat

SEQ ID NO: 7146 - DNA, 288 bp, Homo sapiens
aattaattaataagagtgaatgacaggtgcttttttagagaaggtcttgagatgacatttgaggtgaggcccaaatgaagtgaggaggaaggccatggaaaaatctgggaaaagagctttccagttagagcagcaaatagaccatgaggagaaccacccttgctaggacaggggttagagcagagtgaacaaagtaaaaagcagtaaaggatgagatccagtagtgggcatgggctggattgtgtagaaccctgtggagcttaatagaaagtgtggggctttacaaaa

SEQ ID NO: 7147 - DNA, 914 bp, Homo sapiens
  misc_feature (49)..(49): n is a, c, g, or t
  misc_feature (56)..(56): n is a, c, g, or t
  misc_feature (66)..(66): n is a, c, g, or t
  misc_feature (70)..(70): n is a, c, g, or t
  misc_feature (81)..(81): n is a, c, g, or t
tccgctatctcaattacagctcccctcttcccttctgacaaacaacccnagcaagncgagcgtaanattnacttgcaattnaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatggaaaaaaaaaatccacataaaagtccccccaaagctcatggagacgacgtcttaacatcacgaccgtcgtcaatcgtagtgatcatttctgtactgaaaaaccgcctcatcgtaggaaggatgggccgatgaccaggaccaagagagagggacataacgataccatgtgctccagagggccaacatcctctacgagacgggccgggcctgcc

SEQ ID NO: 7148 - DNA, 419 bp, Homo sapiens
gcggacgcgtgggcattttgtaagacttctattataacattcttaaatccagttcatattgttccagagtcatgtaacatcaaggtggggacacaaaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaag

SEQ ID NO: 7149 - DNA, 2269 bp, Homo sapiens
tttgtaatgttttctttttctcaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaag

SEQ ID NO: 7150 - DNA, 1815 bp, Homo sapiens
ccagaggtccctggcaggtggaaatcaggacaaccggtacaggtgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaag

SEQ ID NO: 7151 - DNA, 3157 bp, Homo sapiens
tttgtaatgttttctttttctcaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtattaagtaatttgttccaagtctcagtcaatacttttaagaagttctttgattttacttttcaggaattatgttgaacacaagtaaacaagttgtcctagacattgagtttgtgagaatttaacattctcaatacagaattttttgataattgcatttggatgatttctcagtgctattgactgaggactttgggcctattctggaatttctaactgtctctaaaggtagttttatagggtagtattctgatgagtcttaacaaaatcttaaagatgtattaataattctctttttctttctttatctgcttttattgggcacacaactccctggatatacaaacacccagttacatgactcaaatcaatatggtcttaaacagtggagaaatgtgatttttaaatatttcacgttatctttttcttggaagcttacttgttattttgaagcttttgaggcagtcattaactataacgtttgtaatgttgggttgggtcatagagatgaaggagctcagtgatggtagtagtacaaacattcaaattcggaggagactcctaggaattagagtatgcaaatgattttcgaaatatttactgtgtctgacatcaagagttagctaattatcaactacatctctatgatctagtagaatatttaatagagttgaatgttctccagttttcttatccactaggaggtacattaaactacattataaatatatattgctaaatcacacatatcaatgagactatgcattagaaaggtttatttattaaacttgcatacaaagttagtagcttttcagagaataatttgtggtgtggtccctactcttgtctctgccctcatttgagatttaactaagtcttctttaactacaggatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaag

SEQ ID NO: 7152 - DNA, 2205 bp, Homo sapiens
tttgtaatgttttctttttctcaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatggaaaaaaaaaatccacataaaagtccccccaaagctcatggagacgacgtcttaacatcacgaccgtcgtcaatcgtagtgatcatttctgtactgaaaaaccgcctcatcgtaggaaggatgggccgatgaccaggaccaagagagagggacataacgataccatgtgctccagagggccaacatcctctacgagacgggccgggcctgcc

SEQ ID NO: 7153 - DNA, 978 bp, Homo sapiens
  misc_feature (49)..(49): n is a, c, g, or t
  misc_feature (56)..(56): n is a, c, g, or t
  misc_feature (66)..(66): n is a, c, g, or t
  misc_feature (70)..(70): n is a, c, g, or t
  misc_feature (81)..(81): n is a, c, g, or t
tccgctatctcaattacagctcccctcttcccttctgacaaacaacccnagcaagncgagcgtaanattnacttgcaattnaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaag

SEQ ID NO: 7154 - DNA, 913 bp, Homo sapiens
tttgtaatgttttctttttctcaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagccaattgaaagcatgtttaattcaaagacctgagctaaggagacctgagcagccggagaccgagcagccg

SEQ ID NO: 7155 - DNA, 488 bp, Homo sapiens
ttttttttttttttttttggcaggcttactccaggtgcaatgtggaaaatagagacaggggaacatttaagcgcagtttaggagcaatgagtggagcagaaccaggatggaagaagtaagcatgaggagaagcaggcagaagtcaggggtgtttggaggtgctgatggggggcagaaaggagcctaggagaaagaagagtattaggcttggtgggggtggtcatgcatcctaaaataattttgaggtcttcacagggggatattgaagtggctgttagagagatagggtttgaagtcaggagagagacataggttaagacataggtttgggttcatgttacagagacccaggacgacagtgatttatacaaaagaaagtgttagttctctgtcgtgtaattacactgaggcaggcagttcaggtgtcctgtgctggctgcagggattcaagctccttccatctcctggctcagccaaccctggcatgc

SEQ ID NO: 7156 - DNA, 404 bp, Homo sapiens
ccccgcaaaggatttttaaatctcttcatcaggacatgcttgatatctggattgggatagcttctggctggtcacccatttgatttggaatgctgctacctgttagggcagggatgggcgatgccatgctcggccccaaggtgccatgggtttgagtgacccacccaagccctccctctgccggcacccagactcctgctaggagtgaaggatggcagcaattttaggactcaacagagaaagggaggttgggcaggactaaagatagagagaccaatgaagagggtctctggcagaacccatcctggagatgcagcaggaagcaagacctcccatgatctaaggtgccaagcccagcgcatgctccgttgtcccttcagacttcacttataacacacaaactc

SEQ ID NO: 7157 - DNA, 873 bp, Homo sapiens
ggagcaggaggctgacaaggaggtagatgaagaaggggaagaaagtggggaggaagaggaggaggaaaaagaaggtgatggtgaggaagaggatggagatgaagaggaagctgagtctgctacaggcaagcgggcagctgaagatgatgaggatgatgatgtcgataccaagaagcagaagaccgacaaggatgactagacagcaaaaaaggaaaagttaaactaaaaaaaaaaggccgccatgacctattcaccctccatttcctgtctcagaatctaaacgtagtcaccttccagtattgaggcccgcccccccaccatgggcagtgccacccacagatgacacacactctccaccacccaacctaaaccgtaagaatttgcaacaggggaggaaaaaacaaccaaaacttccaaggccctgctttttttcttttttcttttttttgaggcagagtcttgctctgtcacccaggctggagtgcagtggtgcgatctcggctcactgcaagttcctcctcccgggttcatgccattctcctgcctcagcctcccgagtagctgggactacaggcgcccgccacgacacccggctgattttttgtatttttagcagagatggggtttcacagtgttagccagtatggtctcgatctcctgacctcgtgatccacccacctcggcctcccaaagtgctgggattacaggcgtgagccatcgcgcccggcctgctttttttcttaaaagtactttaaaaaaagaaatttgcttgtatttttaatttacattttatatttttgtacatattgttagggtcagccacctttaatgatctcggatgaccaaaccagccttcggaccgttctccgtcct

SEQ ID NO: 7158 - DNA, 712 bp, Homo sapiens
tgggagtggcagggtagatggggatactacattttaggacacagcttttcatgagtatatatgccagtgtgaaatctctgaagactttagaaaaattactaatagtgaatttttactcccatacattgggaagaggggagtgattccaaaatcaacttttagaaaccagccatataactgtatccatgtatttcatgctatgatttaagcctcatactccctatggtatgtaaaactcatactcatatgtaagcctcatactccctatggtagtaaaacttaaggccagcaggtaaagattatttctgcatatagatgggattctgtttctttgctgaatttgaatgaataacaccttacatggcataaatatagagtaggattgcccaggtatgaaccccaatttcactaaaatagtaacatgaataatgtgagcaagattacctcttcaaatctcagttttcaccttgatataatagaaataacaacagtgacttttctgaaaagttgctgggcagagtaaaggtggtaatcctttcaaggatctcaatatgatacctgataggcagctaagcactagagagtaactgctattattattactgttgttattattatgtttgcataatactgacatgtttctacttaaattctatcgctgagtgtatttggtatctctaataaaagaaagcattttgaaataaaaagaaaa

SEQ ID NO: 7159 - DNA, 464 bp, Homo sapiens
gaccacatcacagctgcaagttttgctttgttcattgaaggtgattttttagttttaaaatatatatatctcataatatacaatgttgatggtatatcaatccatcaagcattttattagaaagactttataatattattaatttttctttagttttcagtagataaattttcagtctcatcatgggagttagaaaataccagcatcacttaattgtaaagagaaaatgtgaaagtattttccaatccaatgtttcaagtgcctcacttattgtgaatctcaaatatcatcttgagatggtttaatggcagtttggccaagtgatttctaagagattttattaatttatgcattaacaatagtattcaactttcttaggcattataacctaacccgatcatttgattggaataactgaatcattcattgattggaataaaataaagaaaacaaaatgcatctca

SEQ ID NO: 7160 - DNA, 513 bp, Homo sapiens
gaccacatcacagctgcaagttttgctttgttcattgaaggtgattttttagttttaaaatatatatatctcataatatacaatgttgatggtatatcaatccatcaagcattttattagaaagactttataatattattaatttttctttagttttcagtagataaagtagtttcagtagataaagactttataatattattaatttttcttttagttttcagtctcatcatgggagttagaaaataccagcatcacttaattgtaaagagaaaatgtgaaagtattttccaatccaatgtttcaagtgcctcacttattgtgaatctcaaatatcatcttgagatggtttaatggcagtttggccaagtgatttctaagagattttattaatttatgcattaacaatagtattcaactttcttaggcattataacctaacccgatcatttgattggaataactgaatcattcattgattggaataaaataaagaaaacaaaatgcatctca

SEQ ID NO: 7161 - DNA, 617 bp, Homo sapiens
aatgttactctacaatagacagatgtggtagttgccactttaaccaagagctcgaatttagcataatgaattgtggataacttaacatcatgtacttcctgtagtgatacaatgtgaagtacacagtattatctatgacttatcgtcatcaaaaatgtttaacctggctgggtgcagtggctcaggcctgtaatcctagcactttaggagactaaggtgggagagttgttgaggccagtagttggagaccagtctggcaacatagcaagaccctgtctctacacacatagaattagccaggtgtggtggcatgtgcctgtagtccaagtgacttgggaggttgaggcagaagggtcgattgagcccaggagttcgagactgcagtgagctatgatcgtgctactgcactccagcctgggtgacagagcaagaccctgtctcaaaaaaaaaaaaaaaagaaaaagaaagaagtgtaacccaaatctaatcaagctgagtgtagaactaacttcaagtttacgggaatttagtgagtaggggaaaatgttaaacaataccttaagataagtacagaaatgggacataccagtgtagattctttaaatagctttggtcat

SEQ ID NO: 7162 - DNA, 337 bp, Homo sapiens
ctttctcttttagccaagtaattagaattgtcagttttatttattagatttaacccacacagtcaaagagttcagtcaaagggaaacaaaaatagtgatggttcaaccttgtcagtgaatgaataatttaaattaaaatattttcttattgttttatatgtatatccaattatttaagaattaatgcaaattataattaaaactcataccttgatagtgatgtaataaattgatacaaacttctaggagaccagtctgaaaatatgcattaaaaagcatcatgttcttttactgcattacttttcttctgtgattttagcctaaagaagtaattcag

SEQ ID NO: 7163 - DNA, 299 bp, Homo sapiens
taaagagcatttcaggagaggaaagaaactataaaggcctgaaggttcttaaccttagcatctttaagagatagaaagggccgggtgtggtggctcacacctgtaatcccagcactttgggaggccgaggcaggtggattgtgaggtcaggagttcaagaccagcctggccaagatgatgaaaccccgtctctactaaaacctacaaaaattagctggccgcggtggcaggctcctataatcccagctactcaggaggctgaggcaggagaatcacttgaacccaggtggcccaggttg

SEQ ID NO: 7164 - DNA, 369 bp, Homo sapiens
tccaaggtggtcctgttgactttgccatcagcacccttcgacccctgccagcagttccccacctacttagaatcatggtgacacagaccacagcctgaggccaccatggggagcggtctggggatgcagccaaggctgccgcagcctctccctacagggttgggcacaggtgggctgctcttgcaggtgaccacccggttttcctggggaacatctttgaaaacgcgatagtgctgacctgtcccgtgcggtttctaacgcaggcactttaaaaagaaggcccaggctcgatcccgtctttctagttttgtttcacaatgtgaaaattactgctattctttgtaagtgtgcagatgctatgtactcatg

SEQ ID NO: 7165 - DNA, 298 bp, Homo sapiens
ttaaattttctgaaattctctaccatttaaacagtaagtttgaactaccttgaatggaattgataaatactgaatcaactgtaacaatgaatgaaatgaagcttctttctgtttcattagaacttctaaaaacaagattgtatgaaaaaatatagggttatttaataggctttcacagaatattggtaatttcaaattatctaattggttagatagggtcaggattagggtctgaaactatgtattggttgggaaacaatttgtttattttcatactatatattaaagataaaaccat

SEQ ID NO: 7166 - DNA, 515 bp, Homo sapiens
aatcaagatgtaataaagatggaactcagtattgtcactacttagtatctctggcatctgactaattatgttctttacagtcagagtttagggtagtttatgaccaattatgagaccccatcaggactttttttccatattgatgtctgtgtttgcttgatcaacagatttttttaataaaattattttctatgtcttcagcatttttagcgataacagaaaggctgatttacaagagtttatcatacatactgtattggtaagcaattaagtcaaggagacctgagtttaaatacagttctttacttagctgcttacatgaccttagccaaattacttaacctccctgagctgtaattttctcatttgtaaaatgaggatgacaacagtactttagtagaattaagttaaatgtgtagtatttaacaaaataaggtgtatacctagtctgtgctgattagtaaaaaaataacacagcctttcagagtggtagatctttaaaaaaaaaaaaaacc

SEQ ID NO: 7167 - DNA, 502 bp, Homo sapiens
attgcagcttggattctggcacaaacatgggatctctgaatggaagcaatgaattctggttttactggtgctgaggttatgctaatcagttttggggttttcagtctgtgtgagagatctctgattctaggtctctccaactgcttagccctgaatcttcttccaacctttgggaaaccacaggtccttcagggggtcatggtggagtagacacctaggatacaatttaggcatggccccactttcaaaaagggtcccaaatatgagattccagctgtatcaccaatgatatcacccattgaaactcaggcagaatgaagagaacacattcaccatcagttacatgctggcagaagtcaaccctgaatcaatgctttataattcctgtactgatcttgtgagtagaacaacagtattgcatggcatttttgtggttgtaagcatacatttataaaatacacagattttaaagccataaaaaaaaagtcgacgccgccgcgaa

SEQ ID NO: 7168 - DNA, 441 bp, Homo sapiens
gccagcttgtggcatttctgtcagaaacccagctggcatgaaagtgggtttttcatccagcctggagtagccccctgcattcagaaattctttgcctgactacagaagtctaaatcaggactcactttcccccgagctagaggaggaggaatgtgaagccttggaaagagtcggcaccattctgggagtcagattagtacaccccaagaaagggagagtggctgggccagctgcgacacagtccccaaccgctacccgttcctccaccgcccaccaagcccagagcagcctccctcagccagaagacagctcggaggatggaagactgttcaacttgtggcttaagcacattattaaaaccaaagaggaaaattctttgaagagatggggtggagctgaatttaagagaaataataaaaaccatgaccaggtttttctgtg

SEQ ID NO: 7169 - DNA, 326 bp, Homo sapiens
ctctgtgtttaaaaatgtcctacaaatctcaaagaattaatcacttaggagtgtcatctaactctgattttatgacagcccagagttgttcattttacttcagggcatttgagaaatcatccatttatcctctttcaggttttggaaaatatatcttgcgactgccacagattgcatatcctagaaagtgagcttattctggctgaagggaaagaatgtttcagcaagagtggaaattgtaatgggccactcatgaataaaccctacatgggacctgagacccctggcatgaagagtactagcagtttatttaccagagattgact

SEQ ID NO: 7170 - DNA, 413 bp, Homo sapiens
tgccgagaggggcagacaatgaatccttcccgtgtcttaaggacaagcagctgaggccaccccccccctccagctccccctttctgttcccgccaagcttgggaaacacctgctggggaaatcaaaccacagacccatctgctcctctccaccctgttgccacccgggccccaattaggcccagagctgcactggcccggaaagggcctctctcctggttagggctgggcaggggcagggcaggggcagagctggggcactgggacactgggacataggtcagagacccatgcttgaatctccagctccttcgcaggctcacggtacaagttgggggaaatgttacacatctaaggagcctcagtttcttcctctgtaaatggggtaaaaatgcctacctcaaggggctattg

SEQ ID NO: 7171 - DNA, 517 bp, Homo sapiens
aactttttacttctcgtgagggaatatgattgaatcaaagatcactcccatgatgatacacattctgaaagggacttcatgtgtccccttgtgttggaggcacaacacttttcatgtggatgaaaagctaatagaggatgttgaaggggaaaaggtgtggccctgtaccaatggaactgcctgggccattggcctccagttgcttcccagccagtgagaccctcagcaggagttgggagggaagaaaacaaaatcaggacatgtatacccctggctcttcccaggaggaggttgccttgtgctgctgatgtttcacaaccaaaggtcactgctgatctcatagcaataactacagaacacttcccttctaggttccagcaaatgctggctaccctcaccctgcctggcctacatgtggttacagatttcccacaattactatttgtaggatcctgactccctatacttctcatctgttttaaataaaccctctttaaattactctaaaaaaaaaaaa

SEQ ID NO: 7172 - DNA, 552 bp, Homo sapiens
tattggaaggacgctcaaaaagggcttaattttggccgtatacactgatcattcctgggggaaagaccaccattgcatgacaccttaatttacatttccccttccaacaagctgtttctggtacctggactgttgagtgagggctccctctaggggctctgagccaacatccctgtatacaggcgttttcaggcctgagccagaatgcatgtttaggcctaagaaagttgcctcctagggatggaggaggcgtcttaaatctatctttacggcccggcagggtggctcacgcctgtaatcccagcactttgggaggctgaggtgggcggatcacgaggtcaggagattgagaccatcctggctaacacgatgaaaccccatctctactaaaaatacaaaaaattagccgggcgtggtggcaggtgcctgtagtcccagctactcaggagactgaggcaggagaatggcgtgaacccaggaggcggagcttgcagtgagccgagatagcgccactgctacccagcctgggcgacagagtgagactccgtctca

SEQ ID NO: 7173 - DNA, 180 bp, Homo sapiens
caggtgacaggtggggccacaaacctcaaggcaggagtgcgggaggaagcacagcacctgggaccactggcagacccgtcccctgcctcggagatgcctgtccctcccgctgagatcaccgcccgcctgccctagcactgacgcactgaccacgttgctgtcctcagggcaacctgtctc

SEQ ID NO: 7174 - DNA, 394 bp, Homo sapiens
tgctgtgttgaaactggttagccttgcctgttgtatgagagtcgtgattgccactccagaataggactttttccttatttattagtgcctatttgaaatgtctaacatgcgaccgggcatggtggtggctcgtgcctgtaattgcagaactttgggaggccatggcgggtggatcagttgagcgtaggagttggagaccagcctggccaacatagcaaaaccccgtctctactaaaaatacaaaaaattagccaggtgtggtggtgcatgcctataatcccagctacttgggaggctgaggcataagaattgcttgaacccgggaggtggaggttgcagtgagccaggattgcaccactgcgctccagcctgggcaatggagtgagactgtctc

SEQ ID NO: 7175 - DNA, 585 bp, Homo sapiens
ttccaaatgactttggtctgattttatttttctgtgcgtgccacgtctggtttggcattgaggttatactaggcatacggtgtgagttttgaactctccatcttttcccaagttctagaacacagaaattatatgttccttaaaggtttggtagaattagcctataaaactatttacacctggttgctattggttgtttacttatattggacgaatttctgcaagccaattttaataactggtattttactatagtaagcttcattcagcttttcaaacttagtgcactaaagctgcacctgttcttgtgatacacgagctcctgcatagttataattatgccttatttcattcctagtgttttatgtgccttccatcttttcttctagatcagttttgttcactattatttcttttctagtaacttttcagaaagaaaggaaggaaggaggaagggaaaaatatataaaagctctactaacgcacccattttaaaaactagatacttcattaaaactgataggctgtcttttaaaaatcattctgtccagcaattttattattaatgaagactatgttgcttca

SEQ ID NO: 7176 - DNA, 1047 bp, Homo sapiens
caaatgtataatggtctgacacaatctgatgataccaccatctcatcgtagatctgttgtgaccagaaacctcatgtctatgaacaaagactccttttctcccctatctagttgcttcagtggcccctgccagtctttctttttcattcttcttctgagcttgcaggggtgacccttttatgagataccttaatcctttgcatgtctgaatacattgattctggctgtacttgaatcttgctatgtggaaaaccagattttctctttcaaatggcttgtactcccctcagtcattgtgtgttgatctcgagttgaactctgaggggccatcttacttcatgtccttggaaaaaacttcactgtagctgccatataagagcaaaatgctaatctcccattgcatttagccagcatcaccacctcttgaaaacacctttggcttccccacctcctggattaggacaggagcaccttcagtgtgcctcttcagcactgctgagtaaccctcatatcactcttaactgcctctttggtagtttattgattgttcatttccccactaaacttggagctttcagagggcagatgctctcttatttccagatcctactgtctagcgtagtgcctggcacctactcacactattcatttaaccagtttctgttgagcatccactgacacgtagccgaggctagtcactcagctacatgtcaggaataaaggcaaataaggttcttgccctcttggaagtcgaatttcgttcgaggtgagggaggatataaaaagacaaaatagtactcatgataaaacctacaaggaaatagacaatagaatgaggtagagaataattgggatggtctgttgggcatgtacttcaggtgatcggaaaggtctctaaggaagtgccatttagacacaccataaaggcctggtgcagtggctcacactgttaatcccagcactttggaaggccaaggcaagaggattgcttgaggccaggagtttgagaccagcctcgccaacacagcgagatccccatctctattt

SEQ ID NO: 7177 - DNA, 2437 bp, Homo sapiens
  misc_feature (360)..(360): n is a, c, g, or t
  misc_feature (1202)..(1202): n is a, c, g, or t
gcaggtaaaagaaacagggcattgccagcccccataaggccatgtcccctgacaatcatagccctgtatcttccaccaaaggtagaaattatgttaagttttatggtagccaattccttactttccttacacatttaccacctaagtatgtcaccctaaatgatataaattagttgtgcttgttatttaacttcatgtagatgaaattgtagtgtatgtagtttgtgttttgggcttcatttgctcatagttacgtttgtgagatttcatgaagctaaagtttgttcattttccttgttgtattttattgtgaaagttcacccactgtatttattcatcctgttgtttttgttatgatanataatgctgctgtgaacattattgtacctgttctttggtgccttgtgcatatatttctattgggaacacaccaaatagtgaaattgttgtagatgtaatgccatgtatgagagttcctgttgttttgtatactctccaaacttagaactgtcagtctctttaattttagccattctggcatgttcacaggagtatcacattgtgggtttaatttgcatttccctgattacttattactaataatcttttcatatgcttattttcttttagaacgtgcctatgcaagtctcttgtccatttttcaactgttttctatttcttatgaatttgtaggagttctttgcagcttctggctatgcatccttcattaattttgtgtgttgcaaatatattcttccattttgtgacttgtctttttagtctcaaaacagaatcttttgatgagaagaatttcttaattttgatgtaacctcatttatcactcttttccttcatggttggcacttgttgtgtcttgtttgacaatgttgcctatcccaaagtcatgaagattttctcttatgttaacttctaaaagttgtatcatttgtcttttatatttatatctacataatgcacctggaattgagttatatgaatgctgtgaatttgggaggggcgtgtttcctttttttcccacatggatatccaatcaactcagccacatttactgggggaagacatctttttttctaatgcgctgtagtgttaggtttttcaaaacttaggtgtctgtatatgtgtgggtctgtttatgagtctgtctattcttttccactggtctgtttcctacacttgtgccnatgccacactgtcttacttatagctctataagtcttggtattgttaaggaaaaatatttgtaacatttgttaaaaatggcagagaagactttattcaaggaggggaacattgtgataggtagagggactgctgcaacgaggtcttgctgtggtgaggagagagattgggctggagtccaacttctacaaggacaagaggggatttatagtcaagcagcagggtggggtcagtggatggaagaggaaacatcagagacaggggtattcttgctagaccaactcaacagaattcttgctgaaggcaggccagggtgataagatatcaagagttaggggtgaggacagataccaagggtggagaattttcactaaaactagtaggattcttgcttaaactggattctataagacagaaaaggaagcccaaggtcagggtctagtggaagagaaggctccggggagcccgacctgagtttgatctaggagagtctttgtcaatatcctgtagaatatgaccttcacctcattttcttttcctcaagtgtatctggactgtatttggccttttgggcttccaggtgacttttagagtaagtttatcaagatctacaaaaatagctactgagattttgatttgaatagtatttcttcctgataatttctgagtaaaattcattttaaggaagtaggaggggcagtggcctgatgaaaagcaaaaatgaagaaaagaataaggaaagacacagttttgccatcaccagccagtgtttagtgatcttaaaatagctgcttttgtttttgagcatcatttgttgggtatggagttgcagaagttgggttgagggacactggcttctagaatcaaatattggcctccatagagtgtttctgtacagtgagttgggaggatgggcaggggccactgaggactgtggcgtgtccccacgttagagtgtatctcacacagagcctgtcctgaaaatatagttatttttaaaaagtgtttccccctccttttcattggccattttctcttttactactctttacctagcaaagggtgggcatgagaaacctggtcagtggaagagaaagccattttgcaacagtggttataggggtgggagagtaaaatttcctggttcctggggaagctaagcccattggtaggaccagacttttgtatgtgtgtttcttcctttagtcatctactaaggttaataaataccttaaaa

SEQ ID NO: 7178 - DNA, 451 bp, Homo sapiens
gttagtaaactgtggagccaacattcaaataccagggaactcttgattacaaaatccatgttcttaaccactatactatattgcttgtaaaaatcagaactccttaggggtcatgttttatacctaaagaattaattttattatggtttatttgaaaaaaataaatgagaaacctgataaggaaaaagtatgagtgggaaattaccatactagataataaaatgcagtatgaggctacattgttcttcttctttatttatttttattttttttgagacagggtgtggctatgttgcccaggctggtctcgaactcctgggctcaagtgatccgcctgccttggcctcccaaagtgctgggattacaggcgtgagccaccgtgcccagcccaaggctgtgttgtttaaaacacattaaatactggcataggagagagttgagtggaatggga

SEQ ID NO: 7179 - DNA, 452 bp, Homo sapiens
ttttttttttttttttgagacggagcttcactcttgttgcctaggctggagtgcaatggtgtgatctaggctcactgcaacctccacctcccaaactcaagcaattcaccttcctcagccttctgagtagctgacgggggaggatggcttgagcctgggaggtagaggctgcagtcaggcaagataatgccgctgcactccagtctgggcaacacagccagacattatctaaaaaaaaaagtgttattgtaaaatttgcccaataatatagtcaatacaatataactcataccatgaagcaactgctaaaattgctactgcaatcttaggctatattagtaaaagcatacatacaagtaacatgagctaatattgccactgtaatctataaagtttagatgacaatcctagaataaaatttcaattatgaacatctagattgtaagaatatg

SEQ ID NO: 7180 - DNA, 2717 bp, Homo sapiens
  misc_feature (59)..(59): n is a, c, g, or t
  misc_feature (78)..(78): n is a, c, g, or t
  misc_feature (512)..(512): n is a, c, g, or t
  misc_feature (872)..(872): n is a, c, g, or t
  misc_feature (1424)..(1424): n is a, c, g, or t
gtcatcccctcttctcctcaggaactgctcaaacctgtgccccaaagatgagggcccangaggacctcgagggccggncacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggangtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagangtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttngtgctgggattttccatgttcttcgggctcacgctgcccaattacctgagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaataattttagtttcgtaatttatacatagcagtttctttggacaggatatattctcccttcccccaagggaaataatgtatctacattttaaaagtgtgaagtttaagaaaaaaaagcagcattccttttctctttttttgagacatggactcgctctgttgcttagactggagggcagcggaacaatcacagctcactgcagcatcggcctcctgggctcaagtgatcctctggcctctgcctcccaagtacctgggaccacaggcctgtgccaccacacccagctaactttaaactttttgtagaaacagggtctccctttgttgcccaggctggtctcgaactcctgggccaaagtaatcttcccactttggcctcccaaagtgctgggattacaagcatgagccaccacatccaggcac

SEQ ID NO: 7181 - DNA, 2297 bp, Homo sapiens
  misc_feature (59)..(59): n is a, c, g, or t
  misc_feature (78)..(78): n is a, c, g, or t
  misc_feature (512)..(512): n is a, c, g, or t
  misc_feature (872)..(872): n is a, c, g, or t
  misc_feature (1424)..(1424): n is a, c, g, or t
gtcatcccctcttctcctcaggaactgctcaaacctgtgccccaaagatgagggcccangaggacctcgagggccggncacagcatgaaaccaccagggacccctcgaccccgctacccacagagcctaagtttgacatgttgtacaagatcgaggacgtgccaccttggtacctgtgcatcctgctgggcttccagcactacctgacatgcttcagtggtaccatcgccgtgcccttcctgctggctgaggcgctgtgtgtgggccacgaccagcacatggttagtcagctcatcggcaccatcttcacgtgcgtgggcatcaccactctcatccagaccaccgtgggcatccggctgccgctgttccaggccagtgcctttgcatttctggttccagccaaagccatactggctctggagagatggaaatgccccccggaagaggagatctacggtaactggagtctgcccctgaacacctctcatatttggcacccacggatacgggangtccagggtgcaatcatggtgtccagcgtggtggaggtggtgattggcctgctggggctgcctggggccctgctcaactacattgggcctctcacagtcacccccactgtctccctcattggcctttctgtcttccaagctgctggcgaccgagctggctcccactggggcatctcagcttgctccattctcctgatcatcctcttctcccagtacctgcgcaacctcaccttcctgctgcctgtctaccgctggggcaagggcctcactctcctccgcatccagatcttcaaaatgtttcctatcatgctggccatcatgaccgtgtggctgctctgctatgtcctgaccttgacagangtgctgcccacagacccaaaagcctatggcttccaggcacgaaccgatgcccgtggtgacatcatggctattgcaccctggatccgcatcccctacccctgtcagtggggcctgcccacggtgactgcggctgctgtcctgggaatgttcagcgccactctggcaggcatcattgagtccatcggagattactacgcctgtgcccgcctggctggtgcaccaccccctccagtacatgctatcaacaggggcatcttcaccgaaggcatttgctgcatcatcgcggggctattgggcacgggcaacgggtccacctcgtccagtcccaacattggcgtcctgggaattaccaaggtgggcagccggcgcgtggtgcagtatggtgcggctatcatgctggtcctgggcaccatcggcaagttcacggccctcttcgcctcgctccctgaccccatcctggggggcatgttctgcactctctttggcatgattacagctgtggggctgtccaacctgcaatttgtggacatgaactcctctcgcaacctcttngtgctgggattttccatgttcttcgggctcacgctgcccaattacctgagtccaaccctggcgccatcaatacaggcattcttgaagtggatcagattctgattgtgctgctgaccacggagatgtttgtgggcgggtgccttgctttcatacttgacaacacagtgccagggagcccagaggagcgtggtctgatacagtggaaagctggggctcatgccaacagtgacatgtcttccagcctcaagagctacgatttccccattgggatgggcatagtaaaaagaattacctttctgaaatacattcctatctgcccagtcttcaaaggattttcttcaagttcaaaagatcagattgcaattccagaagacactccagaaaatacagaaactgcatctgtgtgcaccaaggtctgaaaaatgacttccaggaaaggaagcatggtatataacaggaaaagaaaactacatggggaaccagaagacctaagcctgaaatcccagccctgcccctaactaacttctgtgtaaactcagataagtcacctttctctgggattcaaatttttgcatcagttaaaaaaaaaggggtgggggggaatgggccaaagtctgagtcttagagacttgtaccaatgttatgctatgtctctaaatctttactctcctaagtagacttgtcagcatctaggaagaacagctagaaattttcctctgtgatattttagactgcaagttgaaaaaaataaaaagaaatgagggcaggttccagggcctgaaatgtaggtatgctgcaaggcttttacattgaatttgaccctacatcacttcaagactaatgcataatattaaacatcatgttgaagaaata

SEQ ID NO: 7182 - DNA, 400 bp, Homo sapiens
cctgctctgagcctcatctccccagctgcaaaatgaagagttatacccacctggagagcgttggggaggaaaaagtaaaatgctgtccaaagccattctacccaggcaccaagctaaggcctttccagggatgactctttctcacttggtatagagtcagataaactaagataagtaaaataagcaagtaagatacagtcagctcttcaccagacatttgcagaggttgatattgttttcttttttgacttgttttattttcattttatttttgagacggagttttgcccttgtcgcccaggctggagtgcaatggtgcggtctcggctcactgcaacctctgcctcctgggttcaaatgattctcctgcttcagcctccaagtagctgggattacaggc

SEQ ID NO: 7183 - DNA, 379 bp, Homo sapiens
gctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcgggggggtcggttattttataagcaaagaagtacagccagtatgattctgaagcaactaggtcacagtagaaaaaagttggagagtgaaatctcaagcaagccaaaaagtgatagatgagttaaaaaaaa

SEQ ID NO: 7184 - DNA, 480 bp, Homo sapiens
acacatatataagcatcagataaatattttaatattatttgtacattatatatctatcagtgattgtaatttgggatcacttttctttcttccaatttcatagtctccttgaaagctgaaaatacgaaaatacaatttgaattaatttccaggtgctgctataacaatgtgggtgtcataaaacaataaaaaatggctcacgcctgtaatcccagcactttgggaggccgaggcaagcagatcacaaggtcaggagttcaagaccagcctggccaagatggtgaaaccccgtctctactaaaaatacaaaaaaaaatagccaggtgtggttgcgggcacctgtagtcccaggtactcaggaggctaaggcagagaattgcttgaacctgggaggtgaaggttgcagtaagcagagatggtgccattgcactccagcctgggtgacagagctagactctgtctcaaaaacaaacaaacaaa

SEQ ID NO: 7185 - DNA, 475 bp, Homo sapiens
agcacagcaatgggtttcaaaattctgatttcccaggcccactgacattgttcaagggtagattccagtgcacagctgtaagaagaagacaacagccttttgataaagaaatgccaagaaattcagtgtggaatctataatggaaacacttggcttctagggcagtaagtccacagtatgtcatttgcagttgaaatgtggagccagcatttatgtgaagcctcttggtcctcatctcaactattgtccactgtattttttattcataatattcccccttctttcataattctgaccccctctctctttaatttagctactgattttatttgtggaagttgtaccttttactcacttggctagcatttatttaataaagggatctggatggggcacacgtagcatccactactgacatggccacagtactgcctctctgagttataaaccaatgctctttcttgatttgcctacc

SEQ ID NO: 7186 - DNA, 404 bp, Homo sapiens
atcacctgaggtcaggggttcgagaccagcctggccaacatggtgaaaccccatctctactaaaaaatacaaaaattagctgggcgtggtggcagctgcctgtaatcccagctactcaggaggctgaggtgggagaatggcttgaacccaggaggcagaggttgcagtgagccgagatcgcgccactgtactccagcctgggtgacagagtaagactctatctatctatctatctatctatctatctatctatctatacacacacacacacacacacacacacacacacacaccctgtatgattaatgatagaaaggggaaggggacttaatgaagagtccacttctcaggggccatgactgttggcaggtttctttccttttgctgtcaatttatttggagaa

SEQ ID NO: 7187 - DNA, 408 bp, Homo sapiens
gaatttaataagtataaacataaacacaaggaataatagttgcactttttcagtctgtacattatgttcccggctggtgcatgcaccaccctgtgaaatacataatcccaagtgctggacttgttataggatgtcaagtgtttggcttatggtttcatttactttcttaccaatgaatgtctcaccatacactgactcttcaatgtaagactcctttgagtgcccctctggagcagagtggaagaagacaaaagataattcaatacacatttcgcataaaaaccaaatatatattttaaattccaagagaatttgaactgttgaaaacttacagtgcttaaggctgatggaaacctcgaacagtgtttgaattaaagtttcagtgataataaagttgatattatacat

SEQ ID NO: 7188 - DNA, 245 bp, Homo sapiens
tatctcccaatataactatttcccactacagtgatcttaatccagccactctcttgctgggacttttcgacaaaatccctcatgactatgttgtaatgattgactgacttgttacccccagggcagacctacaatagatgccactggataaagccaaaatagaatggtatacaggtggatcttatttaagaggagaggatggaaattttagagcaggatatgctgtggtttccttatggaggtaa

SEQ ID NO: 7189 - DNA, 497 bp, Homo sapiens
gtagtatatcaagatagcatcaaaatgataggctaggtaatacaggcaataagtagcaaaggcagaagcaggaagccaaggtcttggtgaggctgaccgatgggcaccctctcccagggcaggcggcttcccgctcccaccagggcccggtgggtcctgggttttctgcaaacatggaggaccactttctgataggacattttcctttcttctttctgttttctttcccttgttttctttcttcctttctgtattttactgaagatatttcatttattgtatattttatatacatgtgcaagactttctataggatatagtcttaaaaagtgaaattgtttggccatagttggcagcaggtgagcctcacctgacaagcatacaggagccagatgaacagcacatgcttacccttttaactgtgcacttctgtatccctggtatcccgtgagcttgaaactctggaccagatttctttggagatgtctgtgctacca

SEQ ID NO: 7190 - DNA, 302 bp, Homo sapiens
ggagctgggtcaaccctccctgaataaatgccattgtctttccttggaagatagcaccaaggaggtcttcatgcgtaacgtgtgaccaggtcctctccagccacagcagactgtttctgctcgtggaaggtgccttaagtaactgctcaccccccttcttgtctctgcaataggtctatgagatcttgaagagaacgacgtgtacaaaggccaagtacagcatgggcatcacgagcctgctggccaatggtgtgtacgcggctgcatacccactgcacgatgtaagtaaccttgacacacga

SEQ ID NO: 7191 - DNA, 3950 bp, Homo sapiens
cggctcggtacccatccccactgtgtgctcgagttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacaggatctccatggccgccgccttggccatgaactcctccccctccgtgcggtccaacatccgggtcacagtcacagccaccgcggtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgacacttttctcacttgaatgc

SEQ ID NO: 7192 - DNA, 3441 bp, Homo sapiens
  misc_feature (155)..(155): n is a, c, g, or t
ccaacaagctcaaagaagaccatgaacccgcacgacatcgtgcaggacgccaacccaaattctcaccctgcctaccagcagtacaccagcaagtccaccctggagcctgggcccacctggcgtggtggcgcccaggcctctccggctcccaagcnttcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcgcttccagaggaacgggggacagccaggctcgcccatgggccttcaggaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacaggatctccatggccgccgccttggccatgaactcctccccctccgtgcggtccaacatccgggtcacagtcacagccaccgcggtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgacacttttctcacttgaatgc

SEQ ID NO: 7193 - DNA, 1413 bp, Homo sapiens
cctgtgtctcgcttactgtgcggctatatccgctgattgcagcgactttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgacacttttctcacttgaatgc

SEQ ID NO: 7194 - DNA, 3897 bp, Homo sapiens
cggctcggtacccatccccactgtgtgctcgagttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacaggatctccatggccgccgccttggccatgaactcctccccctccgtgcggtccaacatccgggtcacagtcacagccaccgcggtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgacacttttctcacttgaatgc

SEQ ID NO: 7195 - DNA, 418 bp, Homo sapiens
  misc_feature (410)..(410): n is a, c, g, or t
tccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatggggcaaggcgagggaagaaagaaggactccgcccttctaagtaaaaggcggaaatgtgggaagtatggcatcacgagcctgcgnacctatga

SEQ ID NO: 7196 - DNA, 3812 bp, Homo sapiens
cggctcggtacccatccccactgtgtgctcgagttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacaggatctccatggccgccgccttggccatgaactcctccccctccgtgcggtccaacatccgggtcacagtcacagccaccgcggtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgacacttttctcacttgaatgc

SEQ ID NO: 7197 - DNA, 607 bp, Homo sapiens
gcaaaattatgtgatatgctacaaataatgttacaaataatagaagtttgtacataaccatctctctatgggtttggggcaaaagagtcttcttcattatcaatccttaattactcatttgaataatttttgcttctggttcctacaaccttgggctggatgattttgaagaaactaatccctgagggaagaatgcttctatcaggggcatagtcatggttctgatcaactggcctaagagtacaccctatgtggggcttcacgtactgctacactcacaggcagaattggggattgtttttctggccagagtgattgatcctgattacaagaggacaaatggggtttcttctacataaagggagagttttgtcaagaacccagggagattcgtttgagacattttttagtacttcccttgtcttaatattctgctgttgggaaaactctggggaacccaacaaagacaaggaaggaaggaaggtttgggctatccttctaggtaaagaacccagtctagcgaggtcctgacaaaggctaagggtaacttgaataggtgctagaagaacagagttatacaatattagctacataatttgcagaaccc

SEQ ID NO: 7198 - DNA, 1198 bp, Homo sapiens
attgcactccagcctgggagacaagtgcaaaactccatctcaaaaaaaaaaaaaaatggatggaaatatgtcatgtcagaggtaaattgtgacttgagtaagttttatgttgagcaactctttttgtttacattttctatgttgcccaaataaagtcttattttcataaatcactgctttacataacaacttttcctgcagccctgggtatggtggcacacagttgtagtcccaggtacactggatgctgaggcaaaaggatcatttgaacccagaacttcaaggtcaacctgggcaacatagcaagatcctatctgtagcaaaaatttttttaatgataattctcatgcaaaattcagtttgcactgttttaaaaaatgaaacacttataagagcatggtcataaggcaattctgacttggtgtcaagccatttaaacttagatataacctaggatttaggatccttgctattgtttacatagtaagtccacatttaatatcagtagattattggaaactgcaactatcagcaaaatggtgaacaatgaaacaaattttaccataggccaattgatacaacaagatataagttcctactgcatatttctggtcacaatattatcactgtacttctaaatggagactaaaacacttataacattcaacactgaaataagtgtgaggtatacatacatttttaaaaagattgataaaaacaagtaagatgattatttacccaattattccagttcagagtctcgggtggcaagaacctattcttactcagcatgcaatgcaggaataaaccctgcacaggatgctattccatggcagggcacaaccacattcactcacattgggacacacagtggggaaatgccaattaaccagacatgcacatcttggggatgtgagaggaagcaggagttcctggagaaaacccatgcaggcatggggagaacatgcagaccctacacagatggtagccctgtccaggaatcaatatttattctcatctacattatagcaaaacaacattgaataaaacaactttatttgaggacctgttttacttgtacatctttgggaaaatctttcaacttttattactcataatgttctcaataaaagtgtgttaagaatacatatttcaggaggttttttgagacaatcaaatgtgcaccagccatgcagaa

SEQ ID NO: 7199 - DNA, 454 bp, Homo sapiens
gttttgaaactcaaaaccttgtatttttgttaatctagttacctgccaaatcaaacaggaatccaaagtttcataaccctgctgtgttctctggttactagaaataagcatatttttgatgttttaacaaccttttaaaataataatttctaataatgaaatagaatatttctattttaagtagctattgggtatatctttacataactagatgattatattaaatgggttttttagatgaatgatgtgcatgggcacacattatggaggcctgaccaacatggcgaaaccctgtctctgctaaatatacaaaaattagccaggcgtggtggtatgcacctgtaatcccagctactcaggaggctgaggcaggagaactgcttgaacctggcaagcagaggttgcagtgagccgagatcgtgcacactgcactccagcgctggcacacattaaa

SEQ ID NO: 7200 - DNA, 2306 bp, Homo sapiens
gttttgaaactcaaaaccttgtatttttgttaatctagttacctgccaaatcaaacaggaatccaaagtttcataaccctgctgtgttctctggttactagaaataagcatatttttgatgttttaacaaccttttaaaataataatttctaataatgaaatagaatatttctattttaagtagctattgggtatatctttacataactagatgattatattaaatgggttttttagatgaatgatgtgcatgggtagatatttttaaaatgaaatatgttttttccttttttacttaaatttctttttagaacatactgttatgaacattaacatttattcaagtccttgggacaattcttcttcagttacccagtaaaattttcatgatctctgcaaaacatagattagaaatataaaataacataaattttagaatacagtgagatgacttacacaatttgataattttttatataatattttatgattaaccagttaactgaaacctaaaaacctgtattaactgattaatattgcagcaaaatgtcagttcatgttattgtatcaatcacttatggatacatgattatgctgtcgtgatatgatttctaacaattgtcttgtcatttttagcttttactattataattttaattaaaatatattaaagtcactatgtcataacagactttatattgtgccatgcagtcctattgctcttttgtttcaaatatcatatagtctaaagcaatgattctcattaaatacatgcatcaaaatcaactgcagttattacatgctaactcaaacttacaaaatcaagctctctgtgatcctggttaatacatctaagtacttgagccgataatccaagtactttggggggtcgaggtgagaggatagcatgtggccagaagttcaagaccagcctgggcaacatagcgagactccatctccacaaaaaagtgttaaaaattagccagacatggtggtgcatgtcttagttctaactactcaggaggctgagaaaggaagattactttagcccaggagctcaaaggtgcagtgagctgtgactgcactccagcccgtctaaaaaaaaaaaaaaaggaaagaaaagaaaaaaagaaataaaaaggtatacacattttttttctgaagtggatggaaatatgtcatgtcagaggtaaattgtgacttgagtaagttttatgttgagcaactctttttgtttacattttctatgttgcccaaataaagtcttattttcataaatcactgctttacataacaacttttcctgcagccctgggtatggtggcacacagttgtagtcccaggtacactggatgctgaggcaaaaggatcatttgaacccagaacttcaaggtcaacctgggcaacatagcaagatcctatctgtagcaaaaatttttttaatgataattctcatgcaaaattcagtttgcactgttttaaaaaatgaaacacttataagagcatggtcataaggcaattctgacttggtgtcaagccatttaaacttagatataacctaggatttaggatccttgctattgtttacatagtaagtccacatttaatatcagtagattattggaaactgcaactatcagcaaaatggtgaacaatgaaacaaattttaccataggccaattgatacaacaagatataagttcctactgcatatttctggtcacaatattatcactgtacttctaaatggagactaaaacacttataacattcaacactgaaataagtgtgaggtatacatacatttttaaaaagattgataaaaacaagtaagatgattatttacccaattattccagttcagagtctcgggtggcaagaacctattcttactcagcatgcaatgcaggaataaaccctgcacaggatgctattccatggcagggcacaaccacattcactcacattgggacacacagtggggaaatgccaattaaccagacatgcacatcttggggatgtgagaggaagcaggagttcctggagaaaacccatgcaggcatggggagaacatgcagaccctacacagatggtagccctgtccaggaatcaatatttattctcatctacattatagcaaaacaacattgaataaaacaactttatttgaggacctgttttacttgtacatctttgggaaaatctttcaacttttattactcataatgttctcaataaaagtgtgttaagaatacatatttcaggaggttttttgagacaatcaaatgtgcaccagccatgcagaa

SEQ ID NO: 7201 - DNA, 336 bp, Homo sapiens
actcttctttaatatttaatataagtcagtcctccataggcattccttacttgatttgagaacacacacagttagtgttatatgaataaggagacagtgcattttggtttgcctgggatgatctagtttacctctgtggtaaatcagttaaaactgttcattattttagcacttctttctattccccaaactgacctgttgtggataacaaattgcatggtgaccctagatttgaaaatttggaggcactctgaaagaaagcaattgaaatatggttagaggcattgggaatagcccctatgaagaaatgacaaaaggaattggctttatttgttg

SEQ ID NO: 7202 - DNA, 472 bp, Homo sapiens
caagaatactactgtcactcccttcccccaaatgaggaggagatcactctcttaccaagtcttccccatctttggagtgctctcaccgttaaaaagtgattcaagtttaactgaagcataacgtttctaaaatttttacccactggtgactttggcgtcacacagagcaagcatatccttttttgctcggagggcattcattttattatttcttcatttgacaagtcatgttgaacggtgatcatgtggcaggcctttctcaaggaactgcgcaatagtggtcaacagacaagcaaaatccctgtagtaggaacttatgttccagagattcttcaaatacctgaacataatcaccttggctccttaaatctcctctgctgcaggctaaacatcaaacaatttcttcagtgatgtttgaggattcttgtttactcttctctttcaaataggggaaactgaggttccctccaca

SEQ ID NO: 7203 - DNA, 392 bp, Homo sapiens
cagggtggcacccttattaccagatttccacccagcaattcacacccatgcactcagcccccatatgggcatggtgaggaggtacagaataaaaccggtttcccagtgggttacccccaaatgacctacccaggaagacatttctccaagaagaaaattctgtgttctatccttcttattccagccagaagagatgttgtacagcccggtgacacctcgtgggacaaagcaaccagaaacagaattctagtatgaagtctctaatattaaaaaagaaaatattgcctgtaatcccagcactttgggaagctgaggtgggaggattcctgccttgagttcaaggccaggagttgaagaccagcctgggcaacatagtgaaactccaccactac

SEQ ID NO: 7204 - DNA, 477 bp, Homo sapiens
gctcttttacagcatctcagcactaaagccacactaagctgctataaaatccaaagtggtccctgaccatggagagacactgtggacactgggtttcaccgcgtgtgttccaagggggtatccagtctaaagcaaatggggttttgccagactttaacttataggcaagaggaaaaatacacaaatcatcctctcaaaccagatgttccaggactcaccacaaagctcccttacagaggtctgcagtgaaaccaacccctcgctctcacataatcatcccaccaaactcctgccagcttctagggttaaggataaagacccttttccccttgaaagcagcgaggctgagctgcagtagtaaatgggagcacagagcagagatcacacatgcactggcagcctgtggcccaggtgcgccctggaggcatgttttgtttggctcacacaatgttttagaagttggaacatttcacttag

SEQ ID NO: 7205 - DNA, 561 bp, Homo sapiens
tgtaagagattttggtcgtgtagttagggaacctccactggcctctaaggatcactttgggaatatttggggccacctggttatttcaaagaattagacttgtagaataatgacattgaggtgatttcattggacagtaattcctcgtcaatccttataagctacttgggaagcttggctgaagaaagaaaattagaaatactaaagactgaattttagctcacaaaattgctcagagaaacggtgggccaatggagaagaaagcgccctgttgcagtcattctcctaagttcttttggcatcaggctcattaaagatctcccaggggagacactaacatacactctgctgagctgctggccgcccttttggggaaagtttctcctgaaccacggaattgatcagtgagcggcccgttgtgaaatctgatagagatggacagaggggctccccagctatcttatttagaaccatgcccttacaaacaaccttggcacttacaggttctccactgaagagaattaagcagtagtagagatgtatttacttgatggaataata

SEQ ID NO: 7206 - DNA, 386 bp, Homo sapiens
catctcaaaatattaacacttaaaccacccccaccatgccaccccagttgtccgcctcctcctacaaaatataaaaaatgattctgagggctgggcacagtggcttacgcctataatcccagcactttgggagactgtggcaggcggatcacgaggtcaggagttcaagaccagcctggccaatatggtgaaattccctctctactaaaaatacaaaaactagctgggcacagtggcacgcacctgtagtctcagcttcttgggaggctgaggaagaagaattgcttgaacctgggaggcggaggttgcagtgagctgagatggtgccactgcactccagcctgggcgacagagcgagactctgtctcaaaaaaaaaaaaaaaaag

SEQ ID NO: 7207 - DNA, 3678 bp, Homo sapiens
gacgggctggggaggtggtgccaggctggttgctagctgccgccgctgctcaccccggccgtccggccgcttcattgtcaccgggcctcggggcagtgttgggggtggcggggcgccaggtcgccgacccgaggtttcggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccgctgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacgccaggcggcactgcccaccaggccctcaaggccaacaatgctggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgact

SEQ ID NO: 7208 - DNA, 4118 bp, Homo sapiens
gacgggctggggaggtggtgccaggctggttgctagctgccgccgctgctcaccccggccgtccggccgcttcattgtcaccgggcctcggggcagtgttgggggtggcggggcgccaggtcgccgacccgaggtttcggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccgctgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacgccaggcggcactgcccaccaggccctcaaggccaacaatgctggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggtgaccacggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggagctgtcccccacgccaggcggcactgcccaccaggccctcaaggccaacaatgctggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccactggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgact

SEQ ID NO: 7209 - DNA, 3069 bp, Homo sapiens
ggcacgaggcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttaaaaaaaaaaaaaaaaaaactcgaactagtttctctctctctcgcagcgctgcctgcgccaggccgaggagctgcgggagcagctggagcgggagaaggaggcgctgggccagcaggagcgcgaacgtgctcggcagcggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgact

SEQ ID NO: 7210 - DNA, 803 bp, Homo sapiens
ggtctggcccagaatcccaggggtttgagtttctgggacaggtggaatcaaagcctaggattgctcgtgggccccgtctctgggtgcagcatccttcttgaccctgggtccccgcggacagtcagggtggtcctcactggcggtcctcagggcctgggtgtcaggaaacgcctgctgggtccatcccaggctggagagtctcaggaggacgttctgtgggggcagagctgtctcccccacgccagaactgttggccacctgcgacgtagggctcatcctctgtagagcagagaaatggcaggttcaaggtcctggtggggtttcactttccctgctggccctgagattccacgaactctaggggactccagggcgttgtggggaaacctctggtctgggtctggattccgtcttccagatgtaaacgccacatggcaccggcttctttggcaggagcagcggcagcggtcaggcgaggggaccctcttggacctgcaccagcagaaagaggcagccaggaggaaggcccgggaggagaaggcacgccaagccaggcgagcagccattcaggtgctgaccgcgcagggaccactgagcagcaccgtggcccaggcctgaccgtgcggggctgctgctggggctccctgggccccgggacacttagcctcagggcagcttggctgtggagcctggggtcgtcctctcccagggacagtgctcagcgatgctcccactgcaggccgctgccccgagctgcctccacgagcccatatgtgtggatagttcagccctctggagccctg

SEQ ID NO: 7211 - DNA, 3641 bp, Homo sapiens
gacgggctggggaggtggtgccaggctggttgctagctgccgccgctgctcaccccggccgtccggccgcttcattgtcaccgggcctcggggcagtgttgggggtggcggggcgccaggtcgccgacccgaggtttcggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccgctgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggagctgcaacagaaacgagccctgagagcccagaaggcgagcactgccgagcgtgggccacctgagaatcccagggagaccagagtgccaggaatgcggcagcctgctcaggagctgtcccccacgccaggcggcactgcccaccaggccctcaaggccaacaatgctggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggtgagtccctgtggccagccctgctggacctcggggctgggagcaggcctgaccctgtgggtgtgctgcaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgact

SEQ ID NO: 7212 - DNA, 3848 bp, Homo sapiens
gacgggctggggaggtggtgccaggctggttgctagctgccgccgctgctcaccccggccgtccggccgcttcattgtcaccgggcctcggggcagtgttgggggtggcggggcgccaggtcgccgacccgaggtttcggcgcgactggttccgcatcccctccccgccggccgaatctgcaggccccgcgcgccaggcaggcttcgcggctgcgcccccggcccgcgcaggacctgccttgtccaccatgaaaggcacccgggccatcggcagcgtcccggagcgcagcccagcaggtgtggacctgagtctgacaggtctccctccgcctgtgtcccggcgtcctggcagtgccgccaccaccaagcccatcgtccgctctgtctccgtggtcacaggcagcgagcagaagaggaaggtgctggaggccacagggcctgggggctcccaggccatcaacaaccttagaagatccaacagcaccacgcaggtcagccagcctcggagcggctcccccaggccaacggagcccacagacttcctgatgctcttcgagggcagccccagtgggaaaaagaggcctgccagcctgagcacagcccccagcgagaagggagccacctggaacgtcctggatgaccagccccggggcttcaccttgccatccaatgcccggagttccagtgcccttgactcaccagcgggcccgcggaggaaagaatgcaccgtggccctggcccccaacttcactgctaacaacaggagcaacaagggagcagtgggcaactgcgtcaccaccatggtgcacaaccgctacaccccctcggagagggcgcctccgctcaagagctccaaccagactgccccctccctcaacaacatcatcaaggcagccacctgtgagggcagtgagagcagcggctttgggaagctgccgaagaatgtctccagtgccacccactcagcccggaacaatactgggggcagcacgggcttgcccaggcggaaggaggtgacggaggaggaggctgagaggtttatccaccaggtgaaccaggccgctgtcaccatccagcgctggtaccggcaccaggtgcagcggcgcggagcaggagctgcccgcctggagcacttgcttcaggccaagcgggaggagcagcggcagcggtcaggcgaggggaccctcttggacctgcaccagcagaaagaggcagccaggaggaaggcccgggaggagaaggcacgccaagccaggcgagcagccattcaggtgctgaccgcgcagggaccactgagcagcaccgtggcccaggcctgaccgtgcggggctgctgctggggctccctgggccccgggacacttagcctcagggcagcttggctgtggagcctggggtcgtcctctcccagggacagtgctcagcgatgctcccactgcagggagctgcaacagaaacgagccctgagagcccagaaggcgagcactgccgagcgtgggccacctgagaatcccagggagaccagagtgccaggaatgcggcagcctgctcaggagctgtcccccacgccaggcggcactgcccaccaggccctcaaggccaacaatgctggtggtggcctccctgctgcaggccccggagaccgctgcctgcccacctccgactcatccccagaaccacagcagcctccagaggacaggacgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggaggatgacgccagctctctgacagctgacaacttggagaaatttggaaaactcagtgcgttccccgaacctcctgaggatgggacgctgctatcggaggccaagctacaaagcatcatgagcttcttggacgagatggagaagtctgggcaggaccagctggactcccagcaggaggggtgggtgccggaggcggggccggggcccctggagctggggtccgaggtgagcacgtctgtgatgcggctgaagctggaggtggaggagaagaagcaggccatgctgctgctgcagagagcgctggcgcagcagcgagacctcacggcccggcgggtcaaggagacagagaaggcgctgagccggcagctgcagcggcagagggagcactacgaggccaccatccagcggcacttggccttcattgaccagctgattgaggacaagaaggtcctgagtgaaaagtgcgaggctgtggtggccgagctgaagcaggaggaccagagatgcaccgagcgtgtggcccaggcacaggcgcagcacgagctggagattaaaaaactcaaagaattaatgagcgccaccgagaaagcccgccgggagaagtggatcagtgagaaaaccaagaagatcaaggaggtcactgtccgaggtctggagcccgagatccagaagctgattgcaaggcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgact

SEQ ID NO: 7213 - DNA, 1304 bp, Homo sapiens
aaaaacgtagcttagtagaggcgtgttgcacaagcaggaagtgcggaggctcaagagcctgcacgaggcggagctgctgcagtcggatgagcgggcctcgcagcgctgcctgcgccaggccgaggagctgcgggagcagctggagcgggagaaggaggcgctgggccagcaggagcgcgaacgtgctcggcagcggttccagcagcacctggagcaggagcagtgggcgctgcagcagcaacggcagcggctgtacagtgaggtggctgaggagagggagcggctgggccagcaggcagccaggcagcgggcggagctggaagagctgaggcagcagctggaggagagcagctctgcactgacccgagccctgagggctgagtttgagaagggcagggaggagcaggagcgccggcaccagatggagctgaataccctgaagcagcagctggagctggagaggcaggcgtgggaggccggccgcaccaggaaggaggaggcgtggctgctgaaccgggaacaggagctgagggaagaaatccggaaaggccgggacaaggagattgagctggtcattcaccggctggaggccgacatggcgctggccaaggaggagagtgagaaggctgccgagagccgcatcaagcgcttacgggacaagtacgaggccgagctctccgagctggagcagtcggagcggaagcttcaggagcggtgctcggagctgaagggccagcttggggaggccgagggcgagaatctgcgtctgcagggccttgtgcggcagaaggagcgggcgctggaggatgcgcaggcggtgaacgagcagctttctagcgagcgcagcaacctggcccaggtgatccgccaggagttcgaggaccggctggcagcctctgaggaggagacgcggcaggccaaggccgagctggccacgctgcaggcccgccagcagctggagctggaggaggtgcaccggagggtgaagacagccctcgcgaggaaggaggaggccgtgagcagcctccggacacaacatgaggctgcggtgaagcgggccgaccacctggaggagctgctggagcagcacaggaggcccacgccaagtaccaagtgaccagggatgccgggaacactgtcgaagaacggaaggcagaggacagaggctggacgtgggcccagaggcccacagggacgcccacctgccccccacagaggctggtggttgagatgcccacggctaagcacctgtggctgcattttaacagtaaaggaggccgttgttttcagcgccttgagtgact

SEQ ID NO: 7214 - DNA, 282 bp, Homo sapiens
ggctgctctcagctaccagcagccttgctgcatctgtctccctgctcttttgcaggacgttcttgcccaggatgcagctggggacaacctggagatgatggccccgagcagggggagcgccaagtccagggggccactggaggagctgctgcacacactgcagctgctggagaaggagccggacgcgctgccccgccccaggacccatcacaggggcagatacgcctgggccagcgaggtgaccacggtgtgcgcccgccctgcacagtctgtccacccacg

SEQ ID NO: 7215 - DNA, 267 bp, Homo sapiens
gcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgggcgggctcaccgtttcca

SEQ ID NO: 7216 - DNA, 397 bp, Homo sapiens
ttttaattttctctgaatgtttatatttacttctaccaataatctgggaataagaatgagtaagcagccgggtctattattccagcagctcacccgctctttcagagtatgggtggttcagagacctgaaaatgaaatgtcggttattttacactactaagtgagactcaagaattatgctggctccaggttaaaaggacttctgactcaaaatctgcctcttgagttcatggttcaccacttccagcctggaacttggtgctgattgagacttggaaagaagacaagctccacccaaactgggaagtttcctatcaagtgctcctgaccactgagacagccatgtgaacagctgaatgggggtggactcactatactcgagtcaaggaactggtga

SEQ ID NO: 7217 - DNA, 196 bp, Homo sapiens
cacattattgacagtttcagatattataagctgtatcccagggccctctgacttcaaagtctgggtaattttctcttttcggttcatgaaacagatctgtagtttatcccatttagcaccgtaattgtaagaactattcatgagaccagtagaacctacagaaacaagtcctgagctttgcccttctaagtagtaa

SEQ ID NO: 7218 - DNA, 442 bp, Homo sapiens
aactgtgagaaataaattgctcttgcttataagtcatgtagtttatggtattttgttataccagcccaaacagactaagatagactattagtctaagaaattatttctcatatgcacattaaatccctcttcctgcaaatgaagtccacatctttgtatcataacctaatgttccagttaagtttaggcatcactgaactacaaataaccccttcaggtccttttttttttttcttttttttgagaggaagtctcgctctgtcgcccaggctggagtacagtggcgcgatctcggctcactgcaacctccgcctccagggttcaagcaattctcctgtctcagtctcctgagtagctgtagtcacaggtgcacgtgaccatgcccagctgctttttgtatttttagtatggacggggtttcaccatattggtcaggctggtc

SEQ ID NO: 7219 - DNA, 403 bp, Homo sapiens
gctgggattacaggcgtgagccacagagcctggccttctgttgctagcatttaatagtgaaaggttgcatgctttctgccagagaccaggaacaagccaaatatgtctgctgtcactattcttattcaacatagtgttggaagttctagctaatccagtaagctgagaaaaggaaataaaagacgtgtagattggaaaggaagaaataaaatcctatttgcagatgacatgattgtccgtgtagaaaatcccaagggatctacagaaaacttggagaactaataactgaattccccagggtcacaagatacaagggatacaaggtaaacatgcagaaatccattttatttctatatgccattaatgagtacctagacacaaattaaaaatacattaccattta

SEQ ID NO: 7220 - DNA, 307 bp, Homo sapiens
gagtgaaatctccgagtgctaatgggaaagtaaaatggtgcagctgttctgaaaaaaaaaaaaaaaaagtttggcagtttcttaaaaagttaaacacgtgcctaccatgtgacgcagccattgaacccccaggttatcctagagatacgaaaacgtaagctcacataaaaacctgtatgcgatcgctcatagcagctttgcttggaattgtcaaaacctggaaacaagccaggtcttcaacaagtatgtggataaacaaactgcaatatatccataccatggaatgctactagccaaaaaaaaaaaa

SEQ ID NO: 7221 - DNA, 390 bp, Homo sapiens
ggacagaaaagggagagagggaagtttgctttttttctcctgcatacccttttataccagttgagttttgtcccatgtgtgcatactattaaaaaaccatgatacttgaccaggtgcagtggctcacgctggtaatcccagcactttgggaggccgaggcgggtggatcacctgaggttgggagttcgagaccagcctgaccaacatggagaaaccttgtctctactaaaaatacaaaattagccacgcatggtggtgccttcctgtaatcccagctactcgggaggctgaggcaggagaattgcttgaacccaggaggcggaggttgcagtgagccaagaacgcgctattgcactctagcctgggcaacaagagcaaaattctgcctca

SEQ ID NO: 7222 - DNA, 1165 bp, Homo sapiens
tcctcttaggcagaaatgttaattgacaatcaaaggagtaacaggtgcatacctgaattcacaagcctttggggcccatcttgaatacttctgcagatccaggcctggtttaggttatgccttctttcatccatgctcacctgagagttccagtgttttccttgttcttgtttctgcattcagagttctaaaatttgactctggctggtcattttatcacttctctctcttagagtagactatagatctatatctgaacatttagcttctaattgatttgtattgataataggtgaaaaagaagttaattagcctggaaatgactacaccataagatcagactttggttaaaaatttaaccacattaattttgataatcttttacattcatttaatattagctttgttttatgttaaatttgcaaactttcacatttttatcaatgttcttgagagggaggcaaagaaattctcaatttatgatgcaaaatggaacttcaggtcaattatttgacctctgtgatttagatcacacatcttataagtgggggagcaactgctcagtctgattcctggtatttttttctgttataaagcacactcttaaaaagaaagaattcaaagttgcttccaaaagtacaatataagaaaaataattttaggaaaggtcaaaaatgattagaagaaggaagtgagaattctgttaatttagtctggctttgagctttctgtttgttagccaagacataaagggaaaactttggctcatagaatacttatctgattaaagaaagcacatgaatttgcatggagtacagactttttttggcattgaattctgtgaagaatatattatatgatcttactaggggatatctgtaacaatgaattataccttcactgctaattttgtaaaagatataaaagtaaacttcaaatgagcatttttcttactcttcttaaccattatcacatgaactcattgccaaggttttaggtatgatgatatcagatgaaaaggtacaagatatatgcttaagtgaagcatttacactaggttttagtgttgatgcaatgtatcttttttcattattttacttttaacctattagtctttatgtttaaagtgattttcttattataagtatgtagttgggtcttactt

SEQ ID NO: 7223 - DNA, 244 bp, Homo sapiens
gacctgtttaacattacggtagacatccatgggtcacctccccagcacacatgtcgcctctccaaacagtttcctaatttcctgatagaaccctccctcaattttcaactgcttctagctcctcatgagggagtcctcactgaattaaacccatcaggatattaaaccccctcgccccagtaattcgctctgaaatgaactgataactccatcatagctaatgaaattggaggggacatttgct

SEQ ID NO: 7224 - DNA, 1814 bp, Homo sapiens
aatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtcacaccattgcttgacaaattcttttttagcaagaccaactacatgtatcccacactgcagacaagacgccagcagatttcattcccattgtcaggcttcggcagagctaagcaagcattggccattgagcttaggcacaaagagattaaaggaggaagcagataccggggaaagccagagagtaagtctgcaaacgcacaaccacagtggctggtgacccacaatgacaccagaggcagagggacctcaagggaggcccctcatctacctcagcctacaaagcttgactcaggattatctgaattatattaaaatgtcacttgggttttctgctgacttaaatatatcttacgccaggcatggtggctcacacctgtaatcccaacactgggaaactgaggcaggaggcttgcttgatcccaggagtttgagaccagcctggacaacacagcaagaccctcaattttaacattagccaggagtactagcacctgtggtcctagctactcaggggaccacagaggaaagacaacttgagcccaagaggtcgaggctgcagtgagccatgactgctccactgcactgaagcctcggcaacagggcaagaccctgactccaaaaccata

SEQ ID NO: 7225 - DNA, 360 bp, Homo sapiens
cttgaaggatgctgtgatagtaaatggatttatacatggaacgtgcttgaaataatgcctgacagtttgtaaagacaaggtctcactctgttacccaggctggagtccggtggtataatcatacctcactgcagcctcaaactcctgggctaaagtgatcctcccacctcagcctcctgaatagctagaactacagaaagtgctcccggtgcctgtggtccatagagtggagtgagtctctaagcaaatctggagggactctgggagctgaagattcagaatatctccacttattcttgccatagcctttgctgctcaactgttgggtgccatgatggtatgagctgttcccttcctcag

SEQ ID NO: 7226 - DNA, 381 bp, Homo sapiens
ctaactgtttgggaggcggaggtggtaggttcacttgagctaggagtttgagaccagcctgggcaaaatagcaagaccctgtctctacataaaaaaagaaaagaaaaacattagctgggtgtggtggtgtgctcctgtagtccgagctatttgggaggctgaggtgggagaatcacttgagcctgggcgattgaggctgcagtgagctgtgccactgcactccagcctgggcaacagagcaagagcctggagattttaaattttgtaaaaggccagtgaagttttatatttttctcagcaaaaattatgccagcaagattggaaacaaacagaagactcaaggtatcaaacatatttaaaaaggggtctcaattgactgaa

SEQ ID NO: 7227 - DNA, 447 bp, Homo sapiens
caactcaggaaacagttaacccagaaataatacttagagaagaaaaaaattttatttaaaccattaataccttcagctttcatgacacaaaaaataattctattttctataaaagacccaccatcccccaaaagaaaagaaagttttatggataataagtagctttggaaaaattcagtctgggcacggtggcttttgcctgtaatcccagtactttgggaggctgaggcgggtggatcaggaattcaagaccagcctggctaatatggtgaaacttcctctctactaaaaatacaaatattagctgggcgtggtggtgtgcaccagtaatcccagctactcgggaggctgaggcaggagaatcatttgaacccgggaggcagaggttgcagtgagccaagatcatgccactgtactccagcctgggcgacagagtgagactgtctc

SEQ ID NO: 7228 - DNA, 443 bp, Homo sapiens
tttttttttgctcttgtcacccaggctgcagtgcaatggcatgatcttggctcactgaaacctgtctcctggttcaagcaattctcctgcctcagcctcctgagtagctgggattacaggtgtgcaccaccaagcccagctaatttttttgtatttttagtagagacgggtttcaccatgttggtcaggctggtctcaaactcctgacctcaagtgatccacccacctcggcctcccaaagtgctgggattacagatgtgagccaccgcacccagccttatgcaacattttaaataattttgtaaatgaaatatagttttgactgcaacccatcacaagaggtcaagtgtgaaactttccacttgtggcatcatgccacaactatatgccaaccagttggaaaacctaaaagaaatggataaattggcctttggtctttcaga

SEQ ID NO: 7229 - DNA, 365 bp, Homo sapiens
aagtaagactcctctgtggttttaatgagaaatgtttagtcagtctagtgttttctttttgttatgttagagtgagggtcttttttatgttagagtgagggtcttctgcaaccttctacatcctaattagaagtcatccttggataaattgctttttaaagcccaaactggaaaataaatctgggcctacatatttagaattttagaaagttcagaaataaagttaggaaaggtaaatgaaagtaaacataagttagtgaagtaaaggtaaatttcatgttacctttcagttctcaattcagttctttgatgatctacttgataggagttgaaggctgcagcaagcaatgattgtaccactgcac

SEQ ID NO: 7230 - DNA, 540 bp, Homo sapiens
tataaaacaaagtcttgctttgtcactcacgctggagtgcaattgctcaatcagagctcactgcagcctcgacctcctgggctcaagtgatccttccacctcagcttccctggtagctgggactatagaagcatgccaccacgaccacctaattttcttctgcacagagatggagtctcgctatgttgcccagactggtcttgaactcctgggctcaggtgatcctcccgcctcggcctcccaaaagtgctgggattacaggcatgagccaccatgcctggctggctattgttgtaagccactaagttttgagggatgttttcttacacagcaaaaccaacccatacagagctctatcttagactcacctctactcttttcctgtatgctctcctcaggtgactcctatggtttttaaataccatctttacactcacaactcttacattaatgaaaactgttctgaactacaagttcatactcccaatttgccagtgccatttaagtcccacaggcctctcaaagtcttgtctttaagtt

SEQ ID NO: 7231 - DNA, 88 bp, Homo sapiens
gatggcaggtatgtgagcctaggagttgtgtcaataccagctgggcgtcccttccctgtccctctctccccagcccacactcccagtc

SEQ ID NO: 7232 - DNA, 1046 bp, Homo sapiens
gtcatgtgccacataatgacttttcagtgaatgacagaccatatatacgatagtggtcctgtaagattataatacagctactgtaccttttctatgtttagatacacaaatacctactgttatgttacagttacctacagaattcagtacagtaacatgctgtacaggtttgtagcctaggagcaatagggctatatcatgtagcctaggtgtgtagtagactatatactgtctaggttgtgtaaatatatgatgtttacagaatgaaatcacctaatgatgcatttctcagaacatatcatcatcgttaagtgacacatgaatgtacatgttattaatacctcatacaatgtaaatgctatgtaaatagttgttatactgtattgttgagggaccaatgtcaagaaaaacagttgacacattcagtacagtcacaagcatccattttttgaaaatattttcgatttgcagtcggttcaatccatggatacagagctcacagatacggagggccaactgtattgctcttttctctgtttggtcttcattttctttttctttttctttttgcttcaagactaaaactttggcaatttctatataaaataaagctttttcaggccttagttccctcatttataactgatgcctgtgtatctttcttctgttaaagtctgtattctaattgaaatttgacttatttttaaagttgtcagaatttatgtgtcccaaatcggtgacatttcctttgatactcctgcttttgccaggaatgatttggcaacctccgagaatcttggtcaaattcttctgtgtgtcataaggatgagaaatcattactctttaagagtgatttgagcctgggcaacatggcaaaacctcatctctataaaaattagccctgggcttggtgactgtgctcccagctactccagaagctgaggtagagaggattgcttgagcccaggaggtcgaggctgctgtgactgtgaccgcacactgcactccagcctgggcaactgagcaagactcgtctcaaaaaaaaa

SEQ ID NO: 7233 - DNA, 478 bp, Homo sapiens
tattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaatgaga

SEQ ID NO: 7234 - DNA, 336 bp, Homo sapiens
tttttttgcagctattgtaaaagcggttgagttcttgatttgattctcagcttggatgttgttggtgtatagccaactactgatttgtgtacattgattttgtatcctgaaactttactgaatttgtttgtcatatctaggagctttttggataggtctttagggttttctaggtatacaatcatatcattggcaaacagcaacagttttacttcctctttactgattgggatgccctttatttccttctcttgctacggattgctctaggctaggacttccagtactatgttgaatagaacgtggctgaaagtgggcatcctttcttggtgcaac

SEQ ID NO: 7235 - DNA, 458 bp, Homo sapiens
ttttttttttggctcatgcctgtaattccagcactctgggagcccaaggcaggaggatcacttgaggacacgagtgtgaggccagcgtggacagcacagttgagtccccatctccacaaataagttagctgggcatggtcagaggactcgggaggctgaggcaggaggatcgtttgagctcaggaggttaaggctgcagtgagctatgatcgtgccactgcactctagcctgggtgacagtgagatcctttgccttaaaaaaaaagtatgccttttagtattattagaagaaaaccaagtagaagcgactttcctaacttgcaaacgttaaacagctgcactttgtaatgtacagaaaagtttactctatttaggagcttctaggccggtaagcaggacaagatacaaattaagtgcaagagtttgctatttcatagtggccctccgtgctacagaag

SEQ ID NO: 7236 - DNA, 877 bp, Homo sapiens
gaaaaaaaacccaaaaagtgaaaaaagccagtttaggaggtcccagacgggctggttccactgacacacctttctgggagagagccagggcctgtggcaggcggagatgcctgctgctctttttgggggggccatcgctgtgtgctctgtgaatggtggttacttatgaaggttacagggatgtgtgtgtgtgtgaacttgtatgacactacaccaggaaagggcaaattttactgtatgtaaatttaaaaataatttttaaaaagttataaaaaataaagcaaatcacaaacaaaatagcctaaatacaaaagaaaaaaaaatgagacattccggaagataactctatccaactataccattatgaaaattataagtcactttaggccgggcacggtggctcatgtctgtaatcccagcactttgggaggctgaggtgggcggaatcacgtcaggattttgagaccagcctggccaacatggcaaaaccccgtctctactaaaaatataaaaattagccatgtgtggtggcgggcacttgtaatctcagctacttgggaggctgacacaggagaattgcttgaacctgggaggtggaggttgcagtgagctgagatcgcaccactgcactctagcctgggcaacagagcaagactcggtctcaaaaaaaaaacaaaacaaattttataaatcactttaactaaaactctaaattagatcagattataatattcttagtcaaaatacccttttatgaacatgcaccaaacatcaagtagcggtcagggtcagtgaggacgccgtctgtggcggagctggaagtcggctgagatgttcaaacatcccacaacatttagcaaggcttcagacagaggca

SEQ ID NO: 7237 - DNA, 2375 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 7238 - DNA, 1108 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccggtaaggcccccctccatgcagcctcggttctctatcctgaaaatgggatggtccgggcacggaggctcacacactgggcgtggtggtgcacacctgtaattccagctactcgggaggctgaggctggagaatcacttgaacccaggaggcggaggttgcagtgagccaagatcgcgtcactgcactccagcccgggtgacagagtgagactttgtctcccaaaaaaaaaaaaaaaaaaaaaaag

SEQ ID NO: 7239 - DNA, 3193 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaggaggggggggggggcggcgagaaaagaaaacaaaaaaaaagggggggggggggggggcgaaaacaagaaggcagaccaactcgcaagtctggggctgaacgacaaaagaccaggacgtgcgagacacaagcggggggggtgggcgcccaacacaacaaacaaaggcggggggggggaagcacaccgatgcgtgacaaaacaccccagaagaagcaaggcgtcagcagaacagcgagtagctatcaatcaaaaacggcaggagggaggcagcgagaataaaaaatccccaggggcgcgtgggggtgggacaagcaacaagcgaggagcaaagggccagccagaacaacgcaaggagacagcaagagaaaacaaaacaagcgagaacggagagaaaaagaacgccaacacagcaggagccgaagccggcaccaacggccacgcgacagaacccagacaccacagagcagacgagggcagacgagaccacaacccacgaaaccagcgagacagacacgaccaagagccagagacaagacaaacacaagagacgaggaggacacagaaacgagggccaggcgagagacacgcaaagagcgagagaagagcagagacacagcaaggacgacgcagacacgggagaatcagtcagactaacaaacaaaaaccaagaacaaaaaccggaacagtcggcaggatgcaaccagg

SEQ ID NO: 7240 - DNA, 3048 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaaaaaaaaaaaaaaaaaaaaaaaaaaaaaaaaaaaaaaaaaaaaaggggggggggtaaaatttcccccggggggccccaaccattagacgcgattctcaagtttttttgttccaaaagggggccccctttggtggggagccgctaatttataataagcataagagccaggggcgccgcgcttttaaacaacggtctggtgcagtggggaaaaaagcgtgctaagcgtgtgcacactcttgctgggaagaagaaccccttactttgctgtggggggggacacaaatatttgggcaccaaatctccactgaccagagagaattataaagcgcctcaagggggaaattttaacaacttttcagagggtgttgttgagtgggtgtttaacacacgagcgggaaaatagggcctggggggcatgaaaagagttggggcacgaaagcggaatttggattttgcggaaaaattttttttaccgcgcgggttcctgtgttataaaaaccgggacaaacaagagcagccagcacgcacaagacacacagagccaacacatcacagaggcgcagcaagaagcaagacgatcaacaaacacagagagaaaaacaaccagaagtcgaacaagcgcacgacacgagacgtaagtgagacaaaaacataatacaacagaaagagagaga

SEQ ID NO: 7241 - DNA, 1054 bp, Homo sapiens
ttaccgaggattcgtagcatttcagcagcgtaagaagataccagccagcttgtcaccatgcatgacctgaagcagggcctgggcccgtcggggacgagtggtgctcggaaaccagcttccagcaagtacaagctcaaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 7242 - DNA, 2396 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 7243 - DNA, 1069 bp, Homo sapiens
cctccgtggccttccagcctgtctgcccaacctgctcctggtgaccagccagctccctggagagaccccatgggagcctacatggagtctgcaacactggcagccccagggctctggctcaccttccctgtctctctccccctttgtcaccaggactctgtctacatcttccgggaaggggccttgccaccctatcggcagatgttctaccagttatgcgacttgaatgtggaagagttgcagaagatcattcaccgcaatgacggggcagagaattcctgcacagaacgggatgggtggtgcctccccaagaccagcgacgagctcagggacaccatgtccctcatgatccggcagaccatccgctccaagaggcctgctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaa

SEQ ID NO: 7244 - DNA, 2076 bp, Homo sapiens
ccacctccctctcatggctagtaggagagactggtgcttgccccgcccggtggactaactcgcttaattttaaataaaaagtcgaggacacggcggtcgttttcccgaagacatgggccctcccatgggccatttgctccctggaggccctcgcgtcttgctgagcccggggagttaggatgacgcgagcggtgagggaacccggaacaattccttcacagaacaattgaggcgaggcctttgggagtactttgtggaacgaaccccggcgggccctgccagacgcacagggatggcggcggaggcggccgatttggggctgggggccgccgtccccgtggagctgaggcgggagcgacgcatggtgtgcgtggagtacccgggagtggtgcgtgatgtggctaagatgctgccgactctgggcggcgaggaaggcgtctcccggatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcaggggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccgggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaagctgtttgacatccgtcccatctggtcccgaaatgctgtcaaggccaacatcagcgtccacccagacaagctcaaggtcttgcttcccttcatagcctattacatgataacaggcccctggcgcagcctatggattcgatttgggtatgacccccgaaaaaacccagatgccaagatttatcaagtcctcgatttccgaatccgttgtggaatgaaacacggttacgcccccagtgacttgccggtcaaagcaaagcgcagcacctacaactacagcctccccatcaccgtcaagaagacatccagccagcttgtcaccatgcatgacctgaagcagggcctgggcccgtcggggacgagtggtgctcggaaaccagcttccagcaagtacaagctcaaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgctgagggagtgggtggcagagatgagtgcagcagagacgggtgatgcgagggacttgctgtcccccagtgtctggggccctgcctattttctaggttttttagacctttgctgccttcccagtgaggggcgatcatgcacagcctgtgcggccttccttctcgaggcctctcctaggaggccgttatccttactctagaactacatggctgggt

SEQ ID NO: 7245 - DNA, 319 bp, Homo sapiens
ggccagcttcatgtgtgtgaggcggtccagggagcacacaggtttagggccccagctgggaacacacagcttgtgtttccagttcctctctgtagacttcgctcacggggctgcctttgatctcagtacagctctgcctctggcaaaaaccaacactggcatctcttagcagagacccgccctgggactttatgtcccaaccctctccccacccccaggttgcagaagatcattcaccgcaatgacggggcagagaattcctgcacagaacgggatgggtggtgcctccccaagaccagcgacgagctcagggacacca

SEQ ID NO: 7246 - DNA, 472 bp, Homo sapiens
gtagtcctagtctttgaaccctcagagcccaggttccaaacatgattgaagccatcttgaatccatcaaaccaacccatctgccagatgagtaccactgagtttcctaaatgacttgagaaatggaagaaatgcccagtgtagccctgtacaaattgtgaattgtgactttttttttttttaaagttgttttaagacactagattttagggtcatttgttaactggaaaactgttttggatttagatgacaaatactaaatcattaggcccaatttgagaattaaaggggtgattaaagcagaaagagtatctatgccttatttttttttcaaaaattaaaaaataagactttttggaggaatactttacatataaaatctatgctttttaagtgtacaatccaataatttttatgacttaattgtgcaattaacatcagaatctaattttagaacgtttctctcccctaca

SEQ ID NO: 7247 - DNA, 395 bp, Homo sapiens
gaaatgataacactttataatagattatacttcttaaagaattgggataaacatgaaaggtcatagtgactatactatagtgttttattaatttataggatcatcttttcggatagtcacaaatactacccaggccaggccaggcagttgacataattgaatgagtgtcatacaacaggaaatggtatatcctgtagtaaataagggagtttttgtcccattaaaatcagggaatcatcaaccactgcttagtttaatgaaatgaatcttgccacatgggagcgtgggccacatggtaaaagggcccatgtggtttttcaataaaactggaatattagagtttcggatggagttgttatctcaaacacagagctaataaaataaaaatgtagcaa

SEQ ID NO: 7248 - DNA, 794 bp, Homo sapiens
gtgatgtgggagtgaggagggaggtatgacacaggaccccggaaagtgctactccaggtagcagtcccaagtctgtgtctttaatgtgtaccagaaacttctgcccatttgcagctgatgtacccatctaatagtatccaaagtaggtgcaaggtagctgttctaataatgcacatgcattctctagttagcactccatcattattttgaaatacttgcaatggattggaatcccatggtcattagttttggtgaaaatatgttatcttttgggaaaaaaacacattttccccccaaatttcaatattttgaccatgaaagaaaagagctattatatttttaaatataattctaacactttatacattttaagtagtagttaagatggttttaaattttatcacttccttgtataaggttccaagttgatgatgacttcaagaagtgaagagatcatcattaaaaaaaaaacttggccaggtgtggtggctcacacctgtaatcccagcactttgggaggccgaggttgatggatcacctgaggtcaggagttcaacaccagcctggccaacatggcgaaaccctgtctctactaaaaatacaaaaatctgttggttgtggtgatgtgcacccgtaattccagctacttgtgaggctgaggcacaagaattgcttgaaccttgacagaggttgcagtgagccaagatcatgtcagggcactctcgcctgggcaacaagagcggctgtctcagaaaaaaaacaaacaaacaaacaaaaaaaaacccaacaaaaaa

SEQ ID NO: 7249 - DNA, 980 bp, Homo sapiens
tatggtttcccaagcaagaaatgacactttcactgtcagtctttctaggagtctggcagaatccaggaccgggattacccttatttatgaagcgaccttagactaacagtggctctctgggtctccagacaattggccagggactctaaaaaccagaaacaaagttgagagaactccatgctggtggagaaaaacagctggcctttatcaccagaatgtgccccatagaagcagcaaagcagcaagcgacgttcttaaacaagggcctgtgggcctcgtcaagatctggaggaatcatctacgactcactgctgagtgagagggctaggcagtgtctttaaggtcctgccagctttaacattgtatgctttttcttttgttcaatctctcaccacaactggaagtgttgcctcaactacacaggagaaagtttgcagtaacttagagaaaacattattttaatcaccagtgtatgttctcctgctccctggacaaatccatcagcagcggcaacactgaccaggtccagattggggccgctgcggtggatgtgaatccattgaaactaggggtctccagtgctcctgactcctcacagctctgttcctatgacaaggatggtcagcaaagccagcaaccttgaagggggaccttcttctaatctcctccctgcctgctgagagagtgtacagaagcagccacttgtcagctgcgatgaatccaatgataattacataaatcattaacaatacttgatatttgcccatcacatttctcatttcaaagtgctcataaaattgtatctcatgggtggcactgccggcacaacagaattccaaggaaggattacgggctaagtaaataaagcctggaggctgctttaaagcctaggagtctgttattaaccctttcctcctttttgtttaactttttctcatggaaatgttcaaacataccaaaaatagagaaaatactataat

SEQ ID NO: 7250 - DNA, 1078 bp, Homo sapiens
aagacaacctaataaatggaagaatatactgtattcatagatcagaggagccactattgttaagatgccaagtcttcccatttttatctatggataaagtgcaatcccaatcaaaatattagcaaaccttttttgtggagtttgacaagctgatcttgaaattcatatggaagtgcaaaggacttacaaaacaattgataaagaacaaagttggaagtctaaaactttctgataccgagctatgttaaaattacagtaatgagatagtctggtgttggcataaagataggcaaatagattaatgtggcagaatagtaagtcctacaaacaacccacaaattatttatatgaacaactgatttttgacaaagatgcaaaaaggcaattcagtggacaaaatatagtctttcagcaaatatgctggaaaaattgggtgttcttatgcaacaagaaagtaagccttgattcagatctcacatgatatatagaagttaacttaaaatactcatagacctaaatgagaaacctaaaactataaaactttttgaagaaaacttttgacctttgttaggtaaatatttgtcagatacctaccaaaattactgcctttgaaagagagaaaaaggatatatgtgatttgatacaaactaaaaacatttcctcttcaaactcgtttataaagaaatatgaaaatacagatgacagactgaaagaaaatagttgcaaatcatatatctgatacagtactttggtgggtttattttagaaatttaaacatatacccatcatatgacccagatattttacttttagatatctacccaagagaaaacaaaacatatatctatacaaagacttgtacgggaatgttcatagaagttttatttgtaacaacaacaacaacaaaaaacctgggactaactcatattttcatcaacaactgaaaagataaacaaattgtggtatattcatactatgaaatatcacttagcaataaaaagaatgaactattatacacacaacaaaatggattaatctcaaaataattatttcaagtgaaggaatccagattcaaaaa

SEQ ID NO: 7251 - DNA, 820 bp, Homo sapiens
atttgcttataaatatttataatataaacactcaattgctatctgttttttaggttctcctctctctcccagaacagtggtaacaggaactcttgggggcttctccctgttcttgcagatgtggcaggatgtgttcctggggggctcccatgccagtccacaccctctgtggtgtaagcagggattggtaattaatgagatgctaaaccctccagaagtgagcgctcatgtcccagaaacacatcttccacctcagcagccagtgggaaaactagactttgtgtctgcatatttgttcttaaacacactcttctgcagtctaactctgctgaccactttccagtttgctcatatcagaatttcttcggttctaagatgcatattttccttttgtaatcctgacttgttagaaattagaatatgtcttgcagtcaataaaatcctatgacaacatttttttttcttaatggttccctaaaactcctgtagttgatggtgtcttgccttaggtttaatgaaagagattttaatatatggcgtggttatgtggagttgtatctctatcagtattaatgggctcgggatgatttatattcaactgaacccccaaattcaacattttgtgttgaatatttattttatcagttattctttatcctgtactcattttggatacttactaaagtattgtatgtatttgttataataaaatggcttgccgtgtttgaacacactgtgtatctgacaatgttctaagacctaatttgatcttcatgacaactgcataaaatagttactattattctcaattcacaaatga

SEQ ID NO: 7252 - DNA, 457 bp, Homo sapiens
  misc_feature (457)..(457): n is a, c, g, or t
aggtggtgggaggattgcttgagcccaggagatcgaggttgcagcaacagagcaaggccctgcttcaaaagaaaaaaaaaaaacattttctgtcaagaatactacacctcaggaggcagagattgtacctgtatgggtgatactaagtttgatcaagtttggataagatggtgaccaccagaatgctttactgtaatgttaaatctttgcctttgttatctgtagggtgatactttgagaccatgtaaatagccggttcctccacaacctttctttcaactgagtcaacaattgtattaggagtgacaaaatgatgattttctaattctattatgcattccttattagctgcattcttctgtaagtagcccctgctcgtattttagatgatcactatggagtcatggaacactaatattttttaaataaattcaattaaattaacctaaaaaaaaan

SEQ ID NO: 7253 - DNA, 1471 bp, Homo sapiens
aacacctgtggaaaaccagagtcatatggctctatgtcctattttactatattgggaacaaactcaggaatacagtctccagcctggaccataaagccccctgatcagaagtggggagctgtgtcttcccacacattgaaactagtctagtttcaaggggtgagagcatgtctgcaccatttctggtaggctctccctcatggatgcagttcctgagtggattctgtgccctggtgctttctacattaagtagtctctttttaatttgggggatcctcagagtagtgatgggggtgttgggagggatgaaggtcttgtaatttctgactgtcagttgccctaaaatgaactaatgtagatgctctgagcctcccaatgttgttatactgtgcccttgtgggtagcctgttgcagtagttattctggtgtgaacctggaaattccctctgccactgtcctggatgcaaagttgtaaattctgtgggtgaaacccagtcatgaggagctcttccatatgctctttctaggccagagaggcagtctttagcagatggcagacctttacaaagacatcatatgtatccattccaattcatacaggctttcagctgaatggggactttgcagtgatatctcagcttcagtcagcaaatcttccaccaacgcagtgggcagggccttttgttctgaccctcagggccctctcaggaccacccctctcagtcaccctcttctcccttcccctttcagaaggcccccacctgcagtgtattgtattctaggttcctctccctcaccccaggtccctcctcccctctgcccctgatgtaaactcagacatggcttggggtgagttctccttgagctgatactcttgatgcccttatcttttgggtgtccccaatacttgagaatcatctgtagtgttctccttaaccctattgagacactttttccatggacaaaagcatccattcctatgacattaagcctcacttccattaataaacccaactattcaccaccaggagcagctttggcttgggcagtaagtacccatggagagagccaagtgaaccttgggtccagcaccacagacagttccaagactgtacctacttggcagtctgtgtggcctatttttatctgatatgaacaaagacagatttaggttttatgaagttggaaactcatataatttggggagtcctctttaatacaaactgaaaaatttttaattaaaattaggtataaaaataagggtttttttgaatgagaaaagttgacaactatgataaacattatgaaatccagaaaaacaacatcatctttgtattaattactctctgatgctttttgcctacttgttttggttgcttactctttgataatctctttattagctgataacatttatatcattttctgttcataaaatttgaatataatttagtcacatagttaatcaaaa

SEQ ID NO: 7254 - DNA, 910 bp, Homo sapiens
ctgtcttcttagggttctgcctaaaactattttttttcccttcacaacttaaatcctaatcgttttcttatctcagtgttttcagaaacatatctgcttcagactgggaaattatattttactatggcttttatacattacactcccttacttatgaaggaaaccttgaaaattggcacagctaacttcagagtagtaattacacaataggaatagttagacattttatacttttttcccagaatattttatgtataaattttggaagaaattaatcagatgttaaaattggaaaccaggcttaagatggggcttagtattatttaaaattagttgctaggttatataggcttattctcattaagtttgaagatggtatataaagttatatcacttctgttttggcaccaaaaaaaggtagacttatatatcacaaaatttatacaatataaactgtattatttaaccaaaataatgtaacttaaaataagtcaaacattttaaaatgaaattgatatcttattttgatttacagttagaatcttgaggtgttgcgtatgagaaatgaatttattttacttatttatagaaatgaggtcttgctcagtcaaccaggctggagtgctgtggcaccatcttagctcattgcaacctagaattcctggcctcaaacaatcctcctgcctcagcctcccaagtagctgggattacaggtgtgagccaccatgcctgactcagaaacttatttattttctttcagttttcaaattttaaacaatgacttacttaatattatgaatagataccagtcatctcatttaataatttgtcttaataaatgtgatgggtttgaatattaagaagatgaaccattagccaggaattctaattttatgttgctaagagattt

SEQ ID NO: 7255 - DNA, 463 bp, Homo sapiens
gagccaatcagtggtgttcaaattggatggactgtatatttaaacaatatattatttaagcaaagaattaagcactgtaagtatattatttagaggaagcaaatttttaaaaatcccttaaaattatatattaaagactaaattggaaatatagttttagaagaagaaagtggggtaaatgggctaggtgcagtggctcacgcctgtaatcccagcactttgggaggccaaggcgggcggatcacgaggtcaggagaccaagaccatcctggctaacacggtgaaaccctgtctctactaaaaatacaaaaaattagccgggcgtggtggctggcgcctgtagtcccagctattcaggaggctggcggaggagaatggcgtgaacccgggaggcggagcttgcagtgagccgagatagcgccactgcactccagcctgggtgagggagtgagactccgtctca

SEQ ID NO: 7256 - DNA, 211 bp, Homo sapiens
tgaaaagagaaaagcaggtttcaattctcttcttttaagaagagagtatatgtcccaacatttcaaaggccatataagatcctatttttatatcctcctgagctgtgggagctaaaacttaattggttctctaactggtaaatcctttgacagacaatatagcctggaattcagagtcctaatacgtttttttctttgtggttcaacagag

SEQ ID NO: 7257 - DNA, 536 bp, Homo sapiens
ctacagcatgtgatgtgtgctttatgatctaagcactttcagagcctttcaaaaactcagggtctgtgtgtctgggcactgtgaacttgaaagaaagccttcaccctgtccctgataaccttgtgttgtcctcagatgagcccatgtctaaagctcccatggccaaagacagttaccagcttctcacctagccggtcacctctgtctaacttggtatgatcactgacaactttggccaattaatgaagaggtggcctcaaattgttcaggaactcgaaaagcacatgtctgaaggggctaattgtagtgataggaaactataaaagtaaggatgttggattagaagttagctgatcatcaggagatcaagaccagcttggccaacatggtaaaactccatctctactaaacatacaaaaattagctgggtgtggtggtgtgcacctgtagtcccagctactcaggaggctgaggcaggagaatggcttgaacctagaaggtggaggttgcagtgagccgagatctcaccactgcac

SEQ ID NO: 7258 - DNA, 305 bp, Homo sapiens
aggctgaagatggcccagatgctgatttctttaaggagaaatagtactgtatgcttgggttggttggatctcgaagagaattcattgtaaaataaaaatttgtcagccgggcgcggtggctcacgcctttaaaaacaatacaaaaattagccgggcatggtggcgtgcgtctatagtactaggtactccagaggctgaggcaggagaatcgcttgaacctgggaggcagaggttgtggtgacccaagatcttgccactgcactccagcctgagcaacaaagcgagactctgtctctaaataaata

SEQ ID NO: 7259 - DNA, 266 bp, Homo sapiens
tagaattattatagcatttttattagttgaattagtcacaaaccattctagatttaaggacagagtacacagactcctaagatatcaatagaagaagtgccaaaatgatgttcatccttccttttgtggaaacactggcttccattcttctcttaatcctctccttatggagccacaccaggcagatgaagctacatggtatttattccagggatcccagcacagaagcccatgtaaaacctataaaagctataatttcatttcta

SEQ ID NO: 7260 - DNA, 422 bp, Homo sapiens
tagaattattatagcatttttattagttgaattagtcacaaaccattctagatttaaggacagagtacacagactcctaagatatcaatagaagaagtgccaaaatgatgttcatccttccttttgtggaaacactggcttccattcttctcttaatcctctccttatggagccacaccaggcagatgaagctacatggtatttattccagggatcccagcacagaagcccatacttcgttgcggcaaggacttttagtagtgtgctggtatttttccatccatctggccattcatttcttctaattttacgggacagcaaactgaagcaagcttctctctgtgtcctgaagaagatgaagtatgccaaaaaggacataatctctcatttttataaacatgcctgatatgagtgatgatatt

SEQ ID NO: 7261 - DNA, 1177 bp, Homo sapiens
ctccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagacaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatggaatcttaatcttgttcattcccctgccaaaacaaatttaaaagcataaacctgctggaattaattgggcaggattcaccatagtttatatcaccccagaatgtttatgtgtatatgtttatgtatagtatata

SEQ ID NO: 7262 - DNA, 392 bp, Homo sapiens
aagagagctttgcatgtcatgttaaggaacttgaatttatcttgtaggaaatggggagccatcaaaggttttaaacaagggaatggtgtaatcaaatttgtgttttagctagatctctctggcagcagtgtggaggttggctaatctggaatattgtaagagagaggcaaagggaataggcaagaccaatggccccagaggagagattgtgatgtctgaactaggacaggcgtagtaatagtagggatggaaagttgggagagagccaccgtgcccggcccagcagcattatttttaatagccaaaaaagataaatgtccatcaactgatgattggataaacaaggtgtagtacatccatacaatatattattatttgtcaataaaaaggaa

SEQ ID NO: 7263 - DNA, 87 bp, Homo sapiens
ttcataagcttttattcagatatattccacagctattttaaatatgtatagcacagtggttttgagtgaccatttgcctgttaccat

SEQ ID NO: 7264 - DNA, 814 bp, Homo sapiens
acgttgacacttcagcatgtattcaacaaatgtttatcaaaggcatgctgcttgcagagcatttgccaggacttagggatatagtggtagcagaaggcagataaagttccagttcactcacaggagttcatattctgatggaggagacagaaaataagctatagcatatctgtgctttgtgaatttgtcattgctgcctattcccgttgccttttttttacatctgtatttctgctttctctagtacttcaactctgctaagaagttgctgggaagtggcaaatttgatgtggggcatggcttggagctggcctttaactctctgcagatcattttgagcttgctttggagatgcaaaaccaccgtaccatggctcctgtggattgggtctgttttggagaagctttggttttccaagctccacctggattagatagagcacatctttggccctggactgatctgggatccccagttctgtctcccagggcctgatgtagatctggccttcctctggaagtggatgtgggagccttgatgcccactgactcatctgtattacttgttgccctaaaactcagaactaaaagagatcttaaagatcatctaactaccttattttgcaggtgagaaacatgctaggactatgtgagtgactgggttcagggttccacagctagtaggggtggagtaacgggtgtgtccagtcagtgcagtggttcatgcctataattttaacactttgggaggccaaggcaggaggattgcctgaggccaggagtttgagaccagcctgggcaacaaagtgagacct

SEQ ID NO: 7265 - DNA, 340 bp, Homo sapiens
tatcaaaagtacatggattatcacgatgcatattgggtggggaggaatgattaagtaatgggggccgggctcggtggctcacacctgtaatcccagcactttaggaggccgaggcgggcggatcatctgagctgaggagttccataccagcccgggcaacatggggagacccggtctctacaaaaaatacaaaaattagccaggtacagtagtgtgcgcctgtagtcccagctacttgggaggttgagtcaggagaaacacaagcccaggtggcagaggtttcagtgagctgagatcacaccattgcactctagcctgggcgatggagcaagactgtctc

SEQ ID NO: 7266 - DNA, 368 bp, Homo sapiens
aagacaatctcagtctgttgcccaggctggagtgcagtagtgcaaacacagctcactgcatcctccgctgcccgggttcaagtttttctgcctcagcctctggagtagctgggactacaggcatgcaccaccacaccacacccagctaatttttgtatttttagtagagacggagtttagccgtgttagctaggctggtgtcgaactcctgacctcaggtgatccgcccacctcagcttcccaaagtgctgggataacaggcgtgagccacctcacctggcccaacacctttcggtcagtcttcctgcaggccctggagcttgcttattctaaacaacaagagttctgtagggacatgctattttaaa

SEQ ID NO: 7267 - DNA, 622 bp, Homo sapiens
ggagacacacttgccctctagacctgtactctctgggcccattagaacctttgagaatcacattcttcccttttcttgaagattaacgtgcgtttgcaactggatagctctattgtaccttcccgtagaatcccagaagtctaacagcctgccttcatttttgtcctgtctctttctctattcagttcaagctggcagcatttctggtgagatggttaattggttccattcagacctatactaatctctttatcacatggttgtccagccacaccctagtgttctttcaagaacatactttctcattttttgcaatgcggacaggctgagaattttccaaatctttaagtactggttcttttttgcttaacagttccttcaatttatctttctcctctaatattttactataagcagcaaggagaaaacagactccacttgcatcactttgtgtagaaatatcacctgaatattctgcactgcctcactcacaatttctatactccacaaaacactagaacgcaatttgggcaagtcctttgcaaggattccagtttcccattacccattcctcatttctgtctgagacttaaccacaatcaccttaaaattaaaaacaaaa

SEQ ID NO: 7268 - DNA, 463 bp, Homo sapiens
gggaagatttttcatgtgacacctgtgagggaatgtgcatgtccttcctcagccttcagctttctggagtagataagggattactaaaccactgtttcatgtcagtatctggccttatttattaaatcagcaaaacaacacaaaacatgtcattagacactaagcttaaaaatgacatttcaggccaggcacggtggctcaacctgtaacccagcactttgggaggatgaggtgggcggatcccctgagcctaggagttggagaccagcctgaccaacatggtgaaacctcgtctctactaaaaatacaaaaattagctgggaatggtgacgtgtgcctgtaatcccagctacttggaatgctgaggcaggagaatcgcttgaacccgggaggcagaggttgcagggagctgtaatcatgccactgctctctagcctgggcaacagagtgagactccgtctcc

SEQ ID NO: 7269 - DNA, 344 bp, Homo sapiens
aacagctaactttttttagttacggcgtctgagggccagggaaactcatttttaaagaccctcatttcttctgaacttggacagggcttttctaccaagtttctggtgatctgtttattggcaaattgggcctgttttaccattcctcgggcctgtgagtttgtgtgtatttgggtttccgggtggacgtgcactttgtaatatattcgtagtaagtatgcatacacagtgcacaaaccttttccctttcaaagttcttgggcacatgtgttccccatcccagactcccacagccctggagacttcccacaccctggggaagcgtgcaggtttggaagcagtgg

SEQ ID NO: 7270 - DNA, 617 bp, Homo sapiens
gaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatgacattaaatttgtacttgtcatatgacccagtaattccaggtatttataggcatctacccaagagaaataaaagcatatgtctaaacaaagacttgcacctgaatattcataaagcttttgtgataggctgagtaatgcctccctca

SEQ ID NO: 7271 - DNA, 575 bp, Homo sapiens
gaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggtagatgcctataaatacctggaattactgggtcatatgacaagtacaaatttaatgtcataagaaactgccactattttccaaagtggttgtaccactttcacactctcactagcaacatatgagggttctggccaacttccttgtcgattcggccgtgaatttagtagtactagtcgaccctggaat

SEQ ID NO: 7272 - DNA, 573 bp, Homo sapiens
aattaatagaattctagaatctaattaaaatggttcaactctacattttactttaggataatatcaggaccatcacagaatgtctgagatgtggatttaccctatctgtagctcacttcttcaaccattcttttagcaaggctagttatcttcagtgacaaccccttgctgccctctactatctcctccctcagatggactactctgattaagcttgagctagaataagcatgttatcccgggatttcatatggaatattttatacatgagtgagccattatgagttgtttgaaaatttattatgttgagggagggtaaccgctgtaacaaccatcaccaaatctaatcgactgaatacatttgacgtttatttcttgttcacctgacagttcagtgttacctaaatttacatgaagacccagaggcccacgctccttcatttggggctccaccgacctccaaggtttcagggccctctgccccgccttctgcacccacaggggaagagagtggaggatgcacacgcccaggcctggaagtgacgcatgtggcttccccgtccacagacttca

SEQ ID NO: 7273 - DNA, 1105 bp, Homo sapiens
agtcctgagtcttctcagaattagataaccacatccatgtttctacaactaactgttgcacctgctacctgaaggatgaccaaaccagagcttctctgtgtacagactgctgactttaagagtttattctctaaggtgatctagagtttcctgtcatttgactctgttccctgtatttattgctttcttccttttctctgaaatgctattcctttaccttctcttacctttttaaaccctaaaagcaagaaagaactttacttataggaagaaagagctagaggaaggaagtgatgtttggagggtaaataaatggaagtttgggcagctttaacgttccaggctttgagctaggcattgagcgttaactcttacaataacctggggagaatagacagtcatttctttttgtagataagaacagagaatcagaggacagttcattatttcgtacaaaacaaaaagtgcattaagactagtaatgttttaaaaaatcatttgctgtcttttaaactcacagcatagaacggcacttcccaaactccaatgtgcatgggaattgcttgggatcctgtcaaatgtaggttctgattcagcaagtccagcacagatgggtccccaggacactgcatttccgtcacactcccaggtgattctgctgctgctgattcagggagcacactttgaataccaaggacatggactgtgcatttgcctagcattttttttttttgaagcctacaagagggaaaaatatttagatcaaggaaatcagaaggtttctggctctaatcagcccatcacaaaaatgagatgagtatttccctgttgtcataaccccttagggtgaggagtgtatccttggtgacagaccaaaatcaaatcatttttacaaatatttatggagtatggtttgagaggatgaagaagaaaagcatgtggaaacatggggcaaattgggactttttatatctctcatttaaataaagacttgttggctgggcactcacgcccataatcccagcactttgaaaggccaaggcaggaggatcacttgagtgggaggagtttgagaccagcctgggcaatgtggtgaaatgtcatt

SEQ ID NO: 7274 - DNA, 327 bp, Homo sapiens
tgttatttaatattttgctcctaacttgagctgtaaacccacatcttccaagggcccaaactcacatccacccacaaggtcacgttacttttgtcccaactcagaggtgaattaatagaaaaaataactatgttagctgccgtcctgagattcactcccccatcattctgttggtggtgcacttttgaaagtgcctgtcttgctaggccttggggctacaaaggggaaggaggcgggcagggtttatgcagaaggttgacttcagctaaactggagtggagggccatttagtcacttcgttctttcttttcctggctgtgcagaagc

SEQ ID NO: 7275 - DNA, 1205 bp, Homo sapiens
gactgctgagacgcataagaaatcttagctggaatgccttctcagaatcttgattttcaaagtgatggattgggagatcccaagccatgaataaagggtgctcatcacagatggaacaatggcgagagcacacctggacaggggaggggcaggagttctgattcctgacacaggtttcctggttgaatgttctgttgtagaagaatgcaactgagttttctaaacagatcttcttcttgacatccttgctgaacgaaagtgaccggccctctttaagactcagtgtgcttacctctgaaatggagctgtcaatcacatctgcctcacaggcttgttctgaggatgaagtgagaaaatgcccacgaggtgctggttgcagcagctggtgcatagagcttaaaaaggatgcagtcccaaaacatagaaggatttactccagatccaagcaatgagtcaggaacagaaagcctgatgccctcacctggaactctccctcctccctggatgaggaccttccccagaattgcagggcacccacacaagaccaagcaagttcagagaaaattgaaacctgactttagagcctctgggatgttcactacacctcattgaacctgtttggttcacagtagagctccaactaccgtctacttcctgcaactggcctgctgccaactccccagatctcttgtggagctgccggaagagacagcctgccacagaagaaagcagccctcctctttcatggcctcccacatcttgaaacaaacacaagcaaacaaaaaaaagcttgagtcccagcctgattcaccaggtttggttcccaattgttgaaattcccttcccagggctctcagaaccagggttggctggaggggtgaaagaggctggccctgagcccagtaataggacaccaagggggagctaaaagctgggatctggggtgaagatggggtcttccaagctgggaggcagacaccaggccagagcaaccggcctgccccagctcaggcctcttaacccatgcagggcaagagtataaacagaggccacggaccacatgcctcagtatttaaacttataaatcaagctaacataacatgaaatcaaatatgttctatcctcctagcttgacaaatactttcataacgagatggaatgccaggttcagatttagaattttcacactccttaaagttccaagt

SEQ ID NO: 7276 - DNA, 535 bp, Homo sapiens
gaattacgaatgccttttgtttccctggccaaattgtgccctggagttccaggagaacaatgtgtagagcatgagatattttggcttatttgttgctgacttctaattttttttatttttttgagacagaatctcgctgtgttagctaggctggagtgcagtggcgcaatctcggctcactgcaacctccgcctactgggttccagcgattctcttgtctcagcctcccgagtagctgggactgcaggcgtgtgccacccactctgataattttttgtatttttagtagagacggggtttcaccgtgttagccaggatggtctccatctcctgacctcatgatctgcccgcctacgcctcccaaagtgctgggattacaggcatcagccacagcacctggcctatgtattttcaatttaacacaatcaagctcacagtgccaatcagaggtgttttttttttttttatttttatttttagagagtctcacagtgtcatccaggctggagtgcagtggtgcgatttcagctcactg

SEQ ID NO: 7277 - DNA, 197 bp, Homo sapiens
aaacattgagtagataatcaagtggtaagaaattataatcgagtaagttaaaatgaacatgatgttgtaggcggatgacctttatgcatttatttattttattaaatgtatatatgcatttttttcctgaagaggatattcatttctttaatcacattatgcaaatagttcatgacgccaaaatgaaccaatgcatt

SEQ ID NO: 7278 - DNA, 144 bp, Homo sapiens
tgccgaaagcctcaggcaggcaggttgcagtggccttggggcccctgaaacagccccccaggaagagaggctgacccccgctatgacccccactacctccaccgccattcatctgtgcataggggaaggacgtttgagattttc

SEQ ID NO: 7279 - DNA, 951 bp, Homo sapiens
gcatccactaggggttttggaatggatcccctgtgagtaaaggggaactacgaggtaaccttttcctgaaagctgtgaaatcagtctgccaagataaataattataactgataataggcttatcagtgtgaccacagtaaataattccattattatatacatcataccacagcgtagttgctcacttacctgtctcttaagggaacctgcatctaattatcttttaacttttagggctgacatatacttgacctataattgttgaattagccaactcacaccaaactgttttctctttccccgagttcatctggactgtgacataccacagaaatgtgttctgagtttttcttaccaatctaaggcctcacacagggatgaaagtaatttgaaataattatcaggaacattattgtactttatcacatttttatgaaaatacttcagattcctcaaacagtaatattattgattctgtacacattatccaaacccattcttagaaaatacaaaattgcaacattcaatagaacatctttttagtaaacattggatattggttcctacttttattccactggtgggaaaggcttatgtgttcctatgtagtttatgtccaaaccgactgtaagtggttcttctgtcagcactttaaagaatgatggagggcctggcatggcggctcacacctgtaacaccagcactttgggaggccaaggcgggcagatcccttgagaccaggagtttgagaccagcctcgccaacatgatgaagccctgtctctactgaaaatacaaaaaattagctggatgtggtggtgtgtgcctgtaatcccagttgttcggtaggctgaggcatgagaattgcttgaaccagggaggcggagattgcggtgagtggagatggtgccattccactccagcttgggcaacagagcaagactctgtctgg

SEQ ID NO: 7280 - DNA, 482 bp, Homo sapiens
gaaaaaaaaaacaaaaatagccaggtgtggtggcatgtgcctgtagtcacagctgcttgggaggctgacgtgggagaattgcttgagcccagaagttcaaggttgcagtgaactgtgatcatgccactacactccaggctgggcaacacagcaagaccctgtctcaaaaattaaataaaacagtcgattacatccaatgttaccagtgtttgtgaaaaaaccttaagaattttccttataaaaacagacggttgaatagtataccaaaaggaactagatgaactgtcaaaaggagaaataaagaccctttctcacaaggacagagaggtcacagtaagattcatcctaaaagagtaatactaatagctagtatttattgaatatttactttgtgccagtcattattctaagtgctttgcatgtattagctagtttattattcaaaacgttcttgttgaggaaactaagcttcagagagatta

SEQ ID NO: 7281 - DNA, 693 bp, Homo sapiens
cagtgattatattgctaactctcattgcatgatacctttaataaaatgaacaatataagagttaagggcaatgggataaagctacttaatgtgtctcctccactgatcaaaaatattccatatagtcttggtgaggaattccccaggatataaatggctatttacactgtaatgaattataccatatatgatattcactcagtaatgttaataatgaactggctaataattgacaagatgcagtgcctgccagtttatgacattaacttggtttgaaactaacatatgacatagtaccagtgcagtcagagctgcccttaggcatgatgaacatgtggcccgtttttgcctggtgttttggcagcaaagcaggaagcaattttgtgtgggtcattgttctgtcaatttgtggaaaaaattacttcagtctcatataaatatagaatgggtccataaacccttcaactcatttccatggcaaaactcacttttttttttatacatgtccttcagtctcttaattttgtcaggtggagcttgatcttaattttaacctattatcttttatttttgtttgtttttggtgaaggataagagtggtgtttcttttgccctttctggtacaaacagagggacactaagcattaacttaataatcacatttaagacttgaacacatgctacccttcacca

SEQ ID NO: 7282 - DNA, 160 bp, Homo sapiens
ctaagctccagggcccctggagctctggatgtcactggacttagaagcaaatgggagaaggcaaaagaactcttccccttcttcagtcatcttcttttaagaggcctatgtctgcttacatctcattatcctgtgtgtagtcacatggccacacctcact

SEQ ID NO: 7283 - DNA, 308 bp, Homo sapiens
tctttctctcaggcctttcaacgccagctcctgattctaaaaagtactgatcgagcagtaaaagactgaggaatattgtaaatttatacaagtcagtaaactggaagcgagaaaaaaccctgaaggaaggaagaaaccatcttctccagattccttgtagccagccaatactgctcttccagcagatgcgttctgtttcactcttctcctggtctgatgcatgaccttgtgggagacacatttaaacggcttccacttagcaggcctattatttatccgagttttccagctgcggcagtgcccaagtt

SEQ ID NO: 7284 - DNA, 381 bp, Homo sapiens
ctttttttttccctttgacagtgaatattttatcacacagtgctttcctttcttctttctatctcatctctgccctgctatgggtgggtaagggtgtgtgtgtgtagataagaaccaagacacaggagccaggagagatgcacctgcctaaaatcagtctttgatttgctgtttcaacacaagtatgtgaaagtatttttctttgattatgactgctgaattaaaaagaaggcttcattacataattcaacagcccagattttcattaacaacctgaattaaagagaaaaagacagcatcgcccattaaatatcaaataaagatgaaggaggaaatgtaagattttacttgtgaccactagttttttggaaaatgtctaaa

SEQ ID NO: 7285 - DNA, 311 bp, Homo sapiens
gacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaataaag

SEQ ID NO: 7286 - DNA, 412 bp, Homo sapiens
cctgagcctccctgggaagaggcgcattcttctctctgctctctgagctttccgttgcttccctgcccatctgtgctctcagcagcaccagcaaagttggcctcaaacttgaacaaagctgcaggctccagcgtctttctgggagctccgcgggggcagcaggcaggccccagcctctgaactcagctggcttgagaagctcagcccaacccttccagcacccagccggccctccgtctcctgagggacgcccctgcccccgacctggaggccctcagtctgggctggggaatggcgcgctgaggtccctccagagccccttgtcccagcctggagctgcagccgcgcaaggcccaggcccccatggcccacccggtgcagtccgagtttccttcagcacaggagccaggct

SEQ ID NO: 7287 - DNA, 1472 bp, Homo sapiens
cctcttaagaaaacttagcctaccatgacaagtagccccagtctccaaagacagtaccttctaatactgaaaacccacagaagaggctccagggactgcaggaacctgagtgttcaaaccattacagaagagagatgcagaaaatggaaaccattttctccttgaagaaaaggcacagtccaacaagtcacttagaaaatggatgcttgtcagatttgttttctatcctgtagcgtaaagattgtttaaagtttaccattacattctaagagaccccgattgagctggagttgggtagaaggccaggtttatctgaaaagatcgacatacacagaaagctccagtgttctcctgatctacaggccccaccaaatcccagcagcagccttttcttcctcaggctgacttggaatgttctgatatgacaggctacaaaagccagaggggattccagctcctcaccagacccaaggctgccttgggaaaggcccaggccagtgttcctagacaccaggatctcttttccccctcagattttgtaaagggagacttcatggccacaggagcattatcttagattatgcaggacccgggagtgctggcaatgtccctggtcactatgaataattccaaagcctgaactcatttctctccccaagaaaacttactgcatcctacaccagaaaggcaaaaccttcctgttaatctaagagtgatgagatttaaaaaaaaaaaaaatcccacagttttattcttctcccctcccccggcctcaagccaagaaccaaaccagcctaccaagaagatccgactgactggtatgggccagtgccctcttttcactcacagtcctcaggggcaacaactctccccggtgcattaggtcctagaaaccaaattataggctgcctcataaatagagcttggctatttaatcaactgcccctgagctggcaaacagtcctgagtcctgcacacaaatgaggatttttttacatgccattactctgccattttccttagagctggggtgtaatgggaaacctggagcccagtgaaaatctggaagctagaatggatttctctccaaagaaagccctcatcccctttcttcaatggctgtgaaatatggaaagcgccaaaaatctccttccctacacgtgggcaagctgttttgaaaacagtcaccatttttctctagcaataaggtaaagtgcacaaaaatctatccacctgggttggaggagataatgtggaatttctctacttttttttttttttaattcactagggttctcttccacttttacttttagagccccacaccacgatcccaggaaatgttgggctgagggaacttttttagaaactggcccatcagctttccctaggggcagtggcaacgggaaagcgggggaggggaggagctgggcacgtggctggcccgagcagcgagaccccggctgggggca

SEQ ID NO: 7288 - DNA, 468 bp, Homo sapiens
ttaactttaaactcagcagccttttttgaaggtgtcgctgtggaagccaagatcatgtctgggattgaccctaaggttgatggaaggtttctgagcatagttcagcatcatcccaccagggggcagtaggaagctgtgtgcacaaaccatttcatcttgaccaaagtcaaatccgaaccatacaacttttctgtccttgaaccggagcttcattaaaacccttgggcaacatttcaaactttaaaactgtagaaacttttagtgaatatggaagcattgttaagcgtaggttggattttctcttcataaccaatacaggattcaattttgctgggagcatgtcatcatttattttcttgtctgaaatggctgtttttcactggtttcaagatctgaaatatgaatgcattatttacaattatgtaatacccttaccctgagctgtaaaataaaaattaaaaaaacttg

SEQ ID NO: 7289 - DNA, 411 bp, Homo sapiens
gtgcttatggtggtagagaacgtgatgggaatggtggtcgtggcgatgatgatgtcctcatagttgtaaaacaaaatttgtggttattacactatctctagtctggaaaagagacttttatttataagtcttaagcagattgctgactacccagattatgaaatgaactatcccctctcttagccaggtcggaccttggtatttagtactttacctcagttaccttactcattactatttctgaaaaactgacatcttttttcctcgtttaatttctttaaggttaggagaattactctctaagtgtaacgatcaattcatatgagaattttctttatttctgaaccatattaacagttttcctcagttgtttccaaactctgccagttgttcttttgcaggtacttctct

SEQ ID NO: 7290 - DNA, 1034 bp, Homo sapiens
  misc_feature (1000)..(1000): n is a, c, g, or t
atctcttgactttgtgatccatcagcctcggcctcccaaagtgctgggattacaggcgtgagccaccacgcccggccaggtttggcattcttaataacacttggcagatgactaggactctgaggctcagagaggtgaagtaacctgttgggacacacagccatgtgagccaggaccagctctctccctagcttgatgagcctcatttgagtggagaggggagtgcagttggaggagtcctgggggaaggtcagtggaggtggggtggggctgggattgtgggccatctggagaattctgctttgattttcaaggaagttctgagccctggagggattttgagcctggcttccttgagctcctgacagcctgagggggtttattgtgaatatttgtgtttctcatcagtgaaccctttttaaaaacaggcttggaagaggtagtctggtgaaggtacagaaagatttgggggccaggtgcaacagctcatgcctgtagtcctagtactttgagaggctgaggtgggaggatcacttgaccccagaagtttgagactaggagatcccatcgctacgaaaaataaaaaattaagtggtcatggtattgcacaccgtggtgttagctacttgggagcctgaggtgggaggatcgcttgaacctgggaggttgaggctgcagtgagccatgactgtgccactgtcctgcagcctggctgacagagtgagtccctgtctcccccaaaaaagagaaaagttgggggaaatgagtttgaaatttctcggttattgcctttttctgtgcccgggcccccaaatctttctgtaccttcaccagactacctcttccaagccggtttttaaaaagggttcactgatgagaaacacaaatattcacaataaaccccctcaggcggtcaggagctcaaggaagccaggctcaaaatccctccagggctcagaacttccttgaaaatcaaagcagaattctccagatggccaanaatcccaggcccaaccccccccaaagagagaggg

SEQ ID NO: 7291 - DNA, 1164 bp, Homo sapiens
atctcttgactttgtgatccatcagcctcggcctcccaaagtgctgggattacaggcgtgagccaccacgcccggccaggtttggcattcttaataacacttggcagatgactaggactctgaggctcagagaggtgaagtaacctgttgggacacacagccatgtgagccaggaccagctctctccctagcttgatgagcctcatttgagtggagaggggagtgcagttggaggagtcctgggggaaggtcagtggaggtggggtggggctgggattgtgggccatctggagaattctgctttgattttcaaggaagttctgagccctggagggattttgagcctggcttccttgagctcctgacagcctgagggggtttattgtgaatatttgtgtttctcatcagtgaaccctttttaaaaacaggcttggaagaggtagtctggtgaaggtacagaaagatttgggggccaggtgcaacagctcatgcctgtagtcctagtactttgagaggctgaggtgggaggatcacttgaccccagaagtttgagactaggagatcccatcgctacgaaaaataaaaaattaagtggtcatggtattgcacaccgtggtgttagctacttgggagcctgaggtgggaggatcgcttgaacctgggaggttgaggctgcagtgagccatgactgtgccactgtcctgcagcctggctgacagagtgagtccctgtctcccccaaaaaagagaaaagttgggggaaatgagtttgaaatttctcggttattgcctttttctgtgcccgggccccctcttccccccaggagaataatggtaataaagtatggtgctttgatgtgccagatgcctttcattcactttgtatgcattatcttatttaatcctcacaacccttttgggaagagcctaatagttccaactgaatgactgagtcacagagaggctaagaaacttgcccaaggtcacacagctggcaggtgccagcacctggattcagacctagtagtctggctccagagcccacacactgaacgacaatgctgtgttgacgttggccaatgccaagcatgccctttgtgatggagaattgccaggtggcactattaggctcttcgtcgacgcggccgcgaatttagtagtagta

SEQ ID NO: 7292 - DNA, 434 bp, Homo sapiens
tattacattttctccatttactctgtaatgagatatcgcatacctttggtgcccttctacaagttccagtatctcctcttccttccccactttcctttcacctgatgaccatattgtttcagtaagatacgcaattagaagagaatttcagccaggcacggtgactcacacctgtaatcccgtactttgggaggtggaggtgggtggatcatgaggtcaggagattgagaccatcctggctaacacggtgaaaccctatctctactaaaaatacaaaaaaaatagccgggcatggtggcgggcgcctgtagtcccagctacttgggaggctgaggcaggagaatggcatgaacccgagaggcagagcttgcagtgagccgagatcatgccactgcactccagcctgggagatggagcaagactccatctcaaaa

SEQ ID NO: 7293 - DNA, 435 bp, Homo sapiens
attttgtctcttcattaacactttcaaagcatgtatgcttataatttttaaagaagtatctaatatagtctgtacaaaaaaaaaacaagtaactaagtttatgtaaatgctagagtccacttttctaaatcttggatataagttggtatgaaagcacacagttgggcactaaagccccttttagagaaagaggacatgaagcaggagatagttaatagctaagtgtggttgtagtataaagcaagaagcagggtgtttcttgtattaagctgtaagcaggaacctcatgattaaggtctttatcacagaacaaataaaaattacatttaatttacacatgtatatcctgtttgtgataaaaatacatttctgaaaagtatactttacgtcagatttgggtttctattgactaaaatgtgttcatcgggaatggga

SEQ ID NO: 7294 - DNA, 366 bp, Homo sapiens
caaaacagcatccctcattccgtcagagaaacgcgagcccctgccaaggtaccagtgataaggagcttggtggtccctgcctgggagatgcttgcagctcagtcagggggacacagaggtgggtaggtggtgaggacagagggtgatgggcacacagggtgaggagggaagcagtgagagtgcaggaggacacgggtggcccatcggcctcagaggggaagcagggtgttgaagctggatttttttcttttcctttttttttttttttttgagatagggtcttactcggtcacccaggctggagcacagtggcatgatcaaagctcacggcaaccttcacttcttgggttaaagtgatcttccacc

SEQ ID NO: 7295 - DNA, 530 bp, Homo sapiens
gtggaggccggcctctccttagcagtgaaaatgcaaatggatttctttagaaatgtcaacagacacttgacacttatcctttaaggtactccccaacgtgtctcctgactgggccaaatttagtttctcccaaattgctcagaaatggaatgtttgcttttttttttttagcactctgggcttttctacaaactcataaaagttggtgattctaaccaagggatcacaagaaagtggggtgctactttttatgaattaaattcagtacccccattattctctgttttaggttgaagatcttttgatgtcagggacttatgcatttgctccctctccatcacacacagcctggcacacagtaggtgcttcacacaatcttgttaaaaggagcagactctatctggtcaaaatcattcttggaagttcttttctatttgtttgttaaaaggaaaaatggccagagttgagactgtgaaagttcattcctgatttcagaccaaaaaaaataaagctgaacctgagagaaaaac

SEQ ID NO: 7296 - DNA, 659 bp, Homo sapiens
cctgcattctgcacaataggcacgttatcttctctagactgaattcatatccaccttcttaacaaatcaagatatgctaggccagccaagactcctggtggccctggaccccacaatcagctgcttagacccctgtggctacattttgggaaaagagccatgcttattaggccttatttttcctccagaattgacccaggctgattccaaagccctctgggactgtttatacccagggcatgaggcaatggagcccctcctggacaggaagccctgccacaccaagagaagtctcaagaagcagaaatgcctcactcagttctcagctctcttgcagatgaagtcaaagcaggagtagaggaagtcctctacactgacctgctttcagcaactaagtaattttttgctcagctcaaggtccaaaaagggacagggaaactgtctttgtcagaccaggtggcttcaaaggactgaaaggcagacccctttctttgcagacgagtccctcttcctgtaggagaaaaggcaaaactagcttctccaaattctccatgctgcattgtcagtcacaaacacacaaaaaacaccagccctggacaagagaatggaagaagagttaggagatgcccttgatggggtttcattcgatgcaaaaggat

SEQ ID NO: 7297 - DNA, 468 bp, Homo sapiens
atagctgacataggcaaaggcataagggctataataggaagtaacttaatgtgttgtctgcccgggcagagataggaagaaatctgacttataccctaatcatacaaaatacataacaaaaagttagttagttcttccaatctagtatgtgaatatctttttattaagagaattctccagagccagctatcaatgaaaatctaccttccttgaaaactgcatatgtctcaggctttcaaaaatagatagtcctttaagaataatgttcacctaaaacctggaagagagaaagaattattgaaagttttataccatgactactgaataaccaacatgttaaaaaaaaatccaaaaggaaattttaaaactcttgagagaaatgaaaatggaaagtcaacatgccagaacttacaaaatgcagcaaaagcaaatctaagagggaagttcatagcaatcgatggccatatt

SEQ ID NO: 7298 - DNA, 648 bp, Homo sapiens
tctgctaatcacagagtcatcttcacagtgtgaaccctgaatacagatgacccgggttcaaatcacacttctgcttcttttgccaccttggatacagtatcttctcttgatctcagtttcctcatctgcaaaatggacataacggataacaacagcaccaaactccaggattgaatgagttaatacagatgtggagatatttcaggcttggttccaggccactgcaataaagtgaggattgcagtagagcaagtcatacaaattattttggtttcccagtgcacacaaaagttgtatttatactatactgtactgtagtctatgaagtgtgcagtagcattatgtctaaaacaacaatgtacatatcttaattaaaaaatacttttttgtattttttaattaaagccatgctggcttatgctcctagcactttgggaggctggggcgggcagattgcttgaggccaggagttccaaaccagcttgggcaacatagcgagattcaccccctaccaaaaaaagtgaaaacattagccgggaatggtgcatgtgcatctatagtcctagtcacttgggaaactgaggccagaagttcaaggctgcagggagctatgaacagaacttgacagagcgagaccttgtttctaaa

SEQ ID NO: 7299 - DNA, 1309 bp, Homo sapiens
ctgtcaggcgtggatgcgaacatctgtggcatgttttcctcatctgaattccttacccagaaactcagatttttggtccctgactttcaagaatatcttaaggatatttaagtttccttaatctttgagatgagactgctggaaccagcaacgttagccttgccagttagagatgattacagagggcactgaagcatagatttaaaaaaaaggggttcagctgttttggagctgacagggtgacctcctcaaccattctgctttcgccgaagcaaggaacttgtccccagacctagaccctctaaaactcctgctattggctggaccatgacaaactaggatgctcaaatttcataaggatgattgccttaaattgtaaaattggtagacaaataaaggggaccattgcaataataaaacgaataacctacagatatggtctagcagcaccaaactgaccatttcagtaggaaaacaagtaatctggagtaaaagatggatacggtactttggtgttctgtacacaataattttagcaaagaatttaatggccatcatgcatttttgaaacaatccactaaccataaagcaatatatgtgtatcataatcagttaactttataaaaagttgtgctactaaatgtgactaattcacctcccaccccccattggcatgcatttatttttatttatttgtttttatttgtggctctggaatagagtaactttcacttattagtaatgcttaagcttttttccttatttaataccttttttgtttttagttaccccatggcttctaaaaaaataagatccaacttctgaattgccatgttagttaatggtggctaaacagatagcaaagggaatataatataattgttcattgagggctaaaaaagaggaatgctctgaatatttactgtcttcctcctctttaaaaaataatcaatgactttcctcttccattgttcagaatcagaaatgttctttcgtatttgcttctcttctacaagagattatatttggcttattaaaatataaaccatgtccaaatgattgtatttttatctttaacaaattatgcctgggatttgttttttacagaaataaggctaaaggcttctgcttcagtaggggtgacatgtttactcctgtaaaatgattttaatgttactcctgtcaaaatgattttattgcaagtaataagtcttgtgggatcagaacaagcttattgtaaacacatgtttttttcccagtgatctacatcatgccaaatgtctgacaactcaaatgttgatgacagcga

SEQ ID NO: 7300 - DNA, 467 bp, Homo sapiens
ctaaaagcacagcacagaaaatcctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctca

SEQ ID NO: 7301 - DNA, 2045 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaactgccttcctaagcagatgagaaaactcaagatagatgaaggaagacatctgctctgcatctcatagggagtaaaatggcacagttgaaactcaagcattgtcttgtaaatctaaattcattgttttttctccactgtattacactgctcccctttgcccctgtattcaccacggccattgtctgttattgcataatcatagtattccagccatgcccccataattgtttttcttaaataaaatatatcattgaacaagta

SEQ ID NO: 7302 - DNA, 8714 bp, Homo sapiens
  misc_feature (6498)..(6498): n is a, c, g, or t
  misc_feature (6511)..(6511): n is a, c, g, or t
  misc_feature (6584)..(6584): n is a, c, g, or t
  misc_feature (6623)..(6623): n is a, c, g, or t
  misc_feature (6671)..(6671): n is a, c, g, or t
  misc_feature (6695)..(6695): n is a, c, g, or t
  misc_feature (6705)..(6705): n is a, c, g, or t
  misc_feature (6717)..(6717): n is a, c, g, or t
  misc_feature (7562)..(7562): n is a, c, g, or t
  misc_feature (8089)..(8089): n is a, c, g, or t
  misc_feature (8203)..(8203): n is a, c, g, or t
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttggaaaatcatcaccctactgaacttacaaaatatcttgaaaatgtgaaaaatatcattttaaataatgggtacattgtataagtggaagctataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacantggtgtgatcttngctcaccgcaacctccgcctcgtgggttcaaatgattctcctgtctcagcctcctgagtaactggggttacangcgcccaccactacgcccagctaatttttggtatttttngtagacacagggtttcaccatgttggccaggctggtcttcaactcctnaccccaggtgatccgcccacctcngcctcccaangtgctgggattncaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagttaccataatttagatataaagttgtcatgtcctggaatttaaaaaagaaatctctagctgagagatgttaatggtcaggagttgaaaatgacaattgtgctttgctttttatttttattttttgtttacttttgagttttttggagtttttttcctatatttttaattgagaagtaaaaattatatatttatggtgtacaacacgatgtgatacatgtataccttgtggaatggctaaatcaagctntctaacatgttacctcacaaactttttttgtagcgagaacacttaaaattttgtaacaattttcaagtatacagcatattgttattaactgtaatcacgtgatatacagtagatctcttgaacttatatttactaactgcaatttcgtgtccttttacaaacatctccccatttccccatcccccagcctctgataaccagaattttactctccatcccatgaagttgactttttttgcactccgtaagtgagatcatctagaattttggcatgtctttctgtgcctggcttatttcacttaacacagtggtcccctgtgtagctgggaccacaggcgtgtgccactacacccaggtttatccatgttgtcagaaatgacaggatttcctttttttaaaagttgaatggtattctcttatgtatattttccacatttgctttttccattcatccattgatggacagttaaattgattccatatcttggctattgagtaatgctgcagtgaacatgggattgcagatntctcttccacatactgatttcgtttcctttgaacatataccaaatagtgggattggtggataatatggtagttctattttttaatgttttgaggaccctccatactgttttccntaatggctataataatttacattgccaccaacagtgtacaaagcttttctttccttttctctgcatcctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctca

SEQ ID NO: 7303 - DNA, 8645 bp, Homo sapiens
  misc_feature (6429)..(6429): n is a, c, g, or t
  misc_feature (6442)..(6442): n is a, c, g, or t
  misc_feature (6515)..(6515): n is a, c, g, or t
  misc_feature (6554)..(6554): n is a, c, g, or t
  misc_feature (6602)..(6602): n is a, c, g, or t
  misc_feature (6626)..(6626): n is a, c, g, or t
  misc_feature (6636)..(6636): n is a, c, g, or t
  misc_feature (6648)..(6648): n is a, c, g, or t
  misc_feature (7493)..(7493): n is a, c, g, or t
  misc_feature (8020)..(8020): n is a, c, g, or t
  misc_feature (8134)..(8134): n is a, c, g, or t
ttgttgcaaatgacaggatctcattcttttttatggctgaataatactccatcgtgtatatgtaccacattttctttatccatttgtcgttgatggacattatgttgtgtccactcctattatatttttagttctctgtatatttgaaaaaaagactctggagtatagtaactgacacataaataaatgtcaatgtgtattctctttcagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttggaaaatcatcaccctactgaacttacaaaatatcttgaaaatgtgaaaaatatcattttaaataatgggtacattgtataagtggaagctataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacantggtgtgatcttngctcaccgcaacctccgcctcgtgggttcaaatgattctcctgtctcagcctcctgagtaactggggttacangcgcccaccactacgcccagctaatttttggtatttttngtagacacagggtttcaccatgttggccaggctggtcttcaactcctnaccccaggtgatccgcccacctcngcctcccaangtgctgggattncaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagttaccataatttagatataaagttgtcatgtcctggaatttaaaaaagaaatctctagctgagagatgttaatggtcaggagttgaaaatgacaattgtgctttgctttttatttttattttttgtttacttttgagttttttggagtttttttcctatatttttaattgagaagtaaaaattatatatttatggtgtacaacacgatgtgatacatgtataccttgtggaatggctaaatcaagctntctaacatgttacctcacaaactttttttgtagcgagaacacttaaaattttgtaacaattttcaagtatacagcatattgttattaactgtaatcacgtgatatacagtagatctcttgaacttatatttactaactgcaatttcgtgtccttttacaaacatctccccatttccccatcccccagcctctgataaccagaattttactctccatcccatgaagttgactttttttgcactccgtaagtgagatcatctagaattttggcatgtctttctgtgcctggcttatttcacttaacacagtggtcccctgtgtagctgggaccacaggcgtgtgccactacacccaggtttatccatgttgtcagaaatgacaggatttcctttttttaaaagttgaatggtattctcttatgtatattttccacatttgctttttccattcatccattgatggacagttaaattgattccatatcttggctattgagtaatgctgcagtgaacatgggattgcagatntctcttccacatactgatttcgtttcctttgaacatataccaaatagtgggattggtggataatatggtagttctattttttaatgttttgaggaccctccatactgttttccntaatggctataataatttacattgccaccaacagtgtacaaagcttttctttccttttctctgcatcctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctca

SEQ ID NO: 7304 - DNA, 8577 bp, Homo sapiens
  misc_feature (6361)..(6361): n is a, c, g, or t
  misc_feature (6374)..(6374): n is a, c, g, or t
  misc_feature (6447)..(6447): n is a, c, g, or t
  misc_feature (6486)..(6486): n is a, c, g, or t
  misc_feature (6534)..(6534): n is a, c, g, or t
  misc_feature (6558)..(6558): n is a, c, g, or t
  misc_feature (6568)..(6568): n is a, c, g, or t
  misc_feature (6580)..(6580): n is a, c, g, or t
  misc_feature (7425)..(7425): n is a, c, g, or t
  misc_feature (7952)..(7952): n is a, c, g, or t
  misc_feature (8066)..(8066): n is a, c, g, or t
aatatataatttcatcaatgaatatatctgggagtagagattctgttttcatgaaatctgatgattttagtagttaatggctatgtcttaattccccaccccccaacacctgtaatacacatagcttttccaccagataataaatgccttgagaactgattgagtgctttgtgttcttttttggcatttgtctttttagacctgtagagaggcacttaaatgactctgctcactttttactttcttcctaaagaaaaatgaaagagaaaataatcttaaataatactttaataatatacgtagaataaataatctaattgtttatattttaacgtttttattagtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttggaaaatcatcaccctactgaacttacaaaatatcttgaaaatgtgaaaaatatcattttaaataatgggtacattgtataagtggaagctataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacantggtgtgatcttngctcaccgcaacctccgcctcgtgggttcaaatgattctcctgtctcagcctcctgagtaactggggttacangcgcccaccactacgcccagctaatttttggtatttttngtagacacagggtttcaccatgttggccaggctggtcttcaactcctnaccccaggtgatccgcccacctcngcctcccaangtgctgggattncaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagttaccataatttagatataaagttgtcatgtcctggaatttaaaaaagaaatctctagctgagagatgttaatggtcaggagttgaaaatgacaattgtgctttgctttttatttttattttttgtttacttttgagttttttggagtttttttcctatatttttaattgagaagtaaaaattatatatttatggtgtacaacacgatgtgatacatgtataccttgtggaatggctaaatcaagctntctaacatgttacctcacaaactttttttgtagcgagaacacttaaaattttgtaacaattttcaagtatacagcatattgttattaactgtaatcacgtgatatacagtagatctcttgaacttatatttactaactgcaatttcgtgtccttttacaaacatctccccatttccccatcccccagcctctgataaccagaattttactctccatcccatgaagttgactttttttgcactccgtaagtgagatcatctagaattttggcatgtctttctgtgcctggcttatttcacttaacacagtggtcccctgtgtagctgggaccacaggcgtgtgccactacacccaggtttatccatgttgtcagaaatgacaggatttcctttttttaaaagttgaatggtattctcttatgtatattttccacatttgctttttccattcatccattgatggacagttaaattgattccatatcttggctattgagtaatgctgcagtgaacatgggattgcagatntctcttccacatactgatttcgtttcctttgaacatataccaaatagtgggattggtggataatatggtagttctattttttaatgttttgaggaccctccatactgttttccntaatggctataataatttacattgccaccaacagtgtacaaagcttttctttccttttctctgcatcctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctca

SEQ ID NO: 7305 - DNA, 6502 bp, Homo sapiens
  misc_feature (4286)..(4286): n is a, c, g, or t
  misc_feature (4299)..(4299): n is a, c, g, or t
  misc_feature (4372)..(4372): n is a, c, g, or t
  misc_feature (4411)..(4411): n is a, c, g, or t
  misc_feature (4459)..(4459): n is a, c, g, or t
  misc_feature (4483)..(4483): n is a, c, g, or t
  misc_feature (4493)..(4493): n is a, c, g, or t
  misc_feature (4505)..(4505): n is a, c, g, or t
  misc_feature (5350)..(5350): n is a, c, g, or t
  misc_feature (5877)..(5877): n is a, c, g, or t
  misc_feature (5991)..(5991): n is a, c, g, or t
ggcagattcgcgtgtaacattttcatcaagagcgacacatatttagctcaccacaaatggtggaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttggaaaatcatcaccctactgaacttacaaaatatcttgaaaatgtgaaaaatatcattttaaataatgggtacattgtataagtggaagctataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacantggtgtgatcttngctcaccgcaacctccgcctcgtgggttcaaatgattctcctgtctcagcctcctgagtaactggggttacangcgcccaccactacgcccagctaatttttggtatttttngtagacacagggtttcaccatgttggccaggctggtcttcaactcctnaccccaggtgatccgcccacctcngcctcccaangtgctgggattncaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagttaccataatttagatataaagttgtcatgtcctggaatttaaaaaagaaatctctagctgagagatgttaatggtcaggagttgaaaatgacaattgtgctttgctttttatttttattttttgtttacttttgagttttttggagtttttttcctatatttttaattgagaagtaaaaattatatatttatggtgtacaacacgatgtgatacatgtataccttgtggaatggctaaatcaagctntctaacatgttacctcacaaactttttttgtagcgagaacacttaaaattttgtaacaattttcaagtatacagcatattgttattaactgtaatcacgtgatatacagtagatctcttgaacttatatttactaactgcaatttcgtgtccttttacaaacatctccccatttccccatcccccagcctctgataaccagaattttactctccatcccatgaagttgactttttttgcactccgtaagtgagatcatctagaattttggcatgtctttctgtgcctggcttatttcacttaacacagtggtcccctgtgtagctgggaccacaggcgtgtgccactacacccaggtttatccatgttgtcagaaatgacaggatttcctttttttaaaagttgaatggtattctcttatgtatattttccacatttgctttttccattcatccattgatggacagttaaattgattccatatcttggctattgagtaatgctgcagtgaacatgggattgcagatntctcttccacatactgatttcgtttcctttgaacatataccaaatagtgggattggtggataatatggtagttctattttttaatgttttgaggaccctccatactgttttccntaatggctataataatttacattgccaccaacagtgtacaaagcttttctttccttttctctgcatcctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctca

SEQ ID NO: 7306 - DNA, 5185 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatggg

SEQ ID NO: 7307 - DNA, 4756 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtg

SEQ ID NO: 7308 - DNA, 5127 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatcta

SEQ ID NO: 7309 - DNA, 5546 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggaaaaaaaaaaaaaaaaaaaaaaaaaaaaaaaaaaaaaaaaaaaaaaaaaaaaaaaaaaaaaaaaaaaaaaaaaacaacaaaaaaaaaaaaaaaaagggaaaaaaaaactaaaaaaaaaaaaaaacttttgggccccctttgcccaaagtgcttttgacctgggcaggttttttgatggggccccaaattgggcctacttggccaaattcccctttttgggggggtttaaaaatcaatggccccggtttaacacctttggcctgggaaaacccggggttcccccaattaaaacccttggggaaaaacccctttttcccacgtggggataaatccaaagggcccccccaccgacgccctttcc

SEQ ID NO: 7310 - DNA, 5708 bp, Homo sapiens
  misc_feature (3492)..(3492): n is a, c, g, or t
  misc_feature (3505)..(3505): n is a, c, g, or t
  misc_feature (3578)..(3578): n is a, c, g, or t
  misc_feature (3617)..(3617): n is a, c, g, or t
  misc_feature (3665)..(3665): n is a, c, g, or t
  misc_feature (3689)..(3689): n is a, c, g, or t
  misc_feature (3699)..(3699): n is a, c, g, or t
  misc_feature (3711)..(3711): n is a, c, g, or t
  misc_feature (4556)..(4556): n is a, c, g, or t
  misc_feature (5083)..(5083): n is a, c, g, or t
  misc_feature (5197)..(5197): n is a, c, g, or t
gggattttgctgtgttgcccaggctggtcttgaacttctgggctcaagtgatcctctctccaaagtgctgggattacagacgtgagccaccacacccaggcttgttcactttagtggaaatattattttatcagagatgtcttcttaacccctgatgatgttaggaaccccttatgaaatgcctttattagcccctcataccacaaatgtattcacaggtattttccctgggccatttttttaataatgtattgagcacctaccacattgccaagcactatgttagaagctgactacagagtagtaaatacaataataaattgagacttatgttttgtatgtctttaggttttcttacctaatttttctattaattcatttttatggcattttttaaaagtattgatctgtgatggctactgaattttaaaaaaaattgtcttttaccacagatagtttgagaaatattgaattatagcacattcattgtttgctaactaattacaatctaatttttcttggtccattttttaaaggaggcagtgcttgagaaagagttgaagggatagtccatttttgttaaataagcatacagtgttagatcatgtgtaaaactgactttaatttattaatttacttttgtgttatttcaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacagctcatggaagagaatgaatctcttaaacaggaactggctaaagctaaaatggctcttgcagaggctcacttggaaaaagatgctcttcttcatcatataaagaagatgacagttgaatagcaggagtggcagtcaaaactgaaattatagctctggagtaggaaggttatatttataatgtggatgttaccagttaggggaagacttttattttcatgaaaagacaataaaacaaaatggaatgtgatgaagtggtgactatttcaaagccagtttagaaagtattagtacgggcattacaatcttttggttgttttgtgttttggggcttaaccctcttttaagctgttgtgatctagggaagtcaacacatagtgtaaaataattacatgcctaatgaaaagaagatgtcatttcctaattttgatatctcattttcggcattttttaaaatgtaaaaggaaaacctcttgtgttcacacagattgctgaattgatttctccatatttgttaataatttactattatttacaaagattcaaatgcttttatgactaatgtaaaatgaaaagaggcttacattttaaatgttattaaaattatgtacttaaatctataattatttaattattgtaaaaagtccaagcagatcaataaactatataattaatgggtttggaaaatcatcaccctactgaacttacaaaatatcttgaaaatgtgaaaaatatcattttaaataatgggtacattgtataagtggaagctataattttcaacaaaaagatggtacaaatgtaaaagtaaaaagcacaaactatacaaaagcaaaatctatggccaagtgatttaaaagcattacttgtacattcctttaaacatttgttgttagaagcaaaagagtaatttatcctgctaaatttggcaccatttgtaattataaaaattttgattaatactatttatattaatttctttaccttcattttttctccttaaggagttgattgtttttggaaatgtttttttccttgcacataagacagtttcataccattcttatagaatcatattaggtgggtgtttgcacatactaaatttataaagctagttttgattaaagctctatgtgagatatatatacatacacaagtcttctataataagagtcgttggtgaattttgaattctattttgttaggaattaaggttgaaatcaacatgaaagaatctcaatcatgcattataaaataaaagtacatgggtgttaagaaacaagagacttttaaagatttaaaatatatttctgatagaatttaactaagtggtgtgtattttaaaattcacattcttaaacataaatctatccaagatagaaaatgaaatagctggactactctttctttaagatacttgaaaattttaaaccacattgcaacactttatggtgctttgcgtgtttggcatgacatacacagtggtcctggtatataagtgcttgggggaaaatacatattttgtttacattaaattttgaagtgatttaggctttattgaaaacaatactggccttccctccccttctctaacatccattttcatttacgttatttaaaatatacaggcactgttttgggtacagaggatatagccaagagcaaattgatagtagtttacctcagagtattaaaaaaatcataataagtcatgttaatctaaaactatataatagccttagattaaatgtgcagatgtctaattaaagatttaaaatgtatagcgtatgtccttagaacatttgatttttaggtatacattcggcaaaaacagtctgttatggaaaagaaggattgatgggacattaacttcttccgagctaacattgtttctgaagattgacctattctatataaatttaaatttttctatgtttttctttttttttttgcgatgaggtttcgctcttgttgcccaggctggagtacantggtgtgatcttngctcaccgcaacctccgcctcgtgggttcaaatgattctcctgtctcagcctcctgagtaactggggttacangcgcccaccactacgcccagctaatttttggtatttttngtagacacagggtttcaccatgttggccaggctggtcttcaactcctnaccccaggtgatccgcccacctcngcctcccaangtgctgggattncaggcgtgagccaccgtacccggcctctatcgtatattataattgcttattgttatagaagctgaatgttttacttactacttttaaatttatttggtcttcccaaggaaatcatacaaacggtagagattatgataatctgagcattctgtgtgcttagtttgatttttttatttataagcagtactatttttatagatgtttaaaattcataaaacactgtattctgagaggtaggtattattcaaatgttagaaattttttttaaaaaaatgccctgaggcttagaaaggacaaatgactgaaatcacaattagtaatctggtctttagacttaaagcctagttatatgcttttattatagcttagtcattaattcacacattttcccttatcttttttatcttttaaaggtgaccataaaactttaaattgtgtgtgtacgtctatgtatgaggtatatgttaccctgtttgtgttattcaaactacctaaaagataggatgatttttgtttaagtgaatcccaaactagcagtctgagaaatacaggaaagcctgataattgacttaccagagttggctttttttttttaagttaccataatttagatataaagttgtcatgtcctggaatttaaaaaagaaatctctagctgagagatgttaatggtcaggagttgaaaatgacaattgtgctttgctttttatttttattttttgtttacttttgagttttttggagtttttttcctatatttttaattgagaagtaaaaattatatatttatggtgtacaacacgatgtgatacatgtataccttgtggaatggctaaatcaagctntctaacatgttacctcacaaactttttttgtagcgagaacacttaaaattttgtaacaattttcaagtatacagcatattgttattaactgtaatcacgtgatatacagtagatctcttgaacttatatttactaactgcaatttcgtgtccttttacaaacatctccccatttccccatcccccagcctctgataaccagaattttactctccatcccatgaagttgactttttttgcactccgtaagtgagatcatctagaattttggcatgtctttctgtgcctggcttatttcacttaacacagtggtcccctgtgtagctgggaccacaggcgtgtgccactacacccaggtttatccatgttgtcagaaatgacaggatttcctttttttaaaagttgaatggtattctcttatgtatattttccacatttgctttttccattcatccattgatggacagttaaattgattccatatcttggctattgagtaatgctgcagtgaacatgggattgcagatntctcttccacatactgatttcgtttcctttgaacatataccaaatagtgggattggtggataatatggtagttctattttttaatgttttgaggaccctccatactgttttccntaatggctataataatttacattgccaccaacagtgtacaaagcttttctttccttttctctgcatcctctccaacacttcccttttgtcttcttgataatagtcattctaacgggtatgattacagtagctttgtagtgggttttctgtgctgtgctttttaatttcatgtatgtaaaaaacattgggtattttgaatgtttttcttttctcaccttatcctagaacttgaggctgggcgcggtggctcatccctgtaatctcagcactttgggaggccaaattgggcagatcacttgaggtcaggagttcgagaccagcctggccaacatggtgaaaccccatttctactaaaaatacaaaaattagccaggcgtggtggtgcacgcctgtagtcccagccaatcagtaggctgaggcacgagaatcgcttgaacccaggaggccaaggctgcagtgagccacgattgcaccactgcactctaacctgagcaacacagactccatctca

SEQ ID NO: 7311 - DNA, 4698 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagagaaggactaccctctgaaagggacatgcagaacaccttcagtattatctcaacaatcaaaagctaagctaatgtctagttctgttgtggttagacttgcagatttcaatatataccaggtctctacagcggaacaatgtcgttcttcccccaaaagcatgatttgctgcaataaaaaatccctatatcttccacaagaaatgtcagctgtctatatagaattcacagaatattactatccagatggaaaggattttccaattccatctcccaacctctatagccagctgaatgcactacagtttactgtggatgaaagaagcattctatggttaaatcaatttctgttggatttaaaacagagtcttaatcagttcatggctgtgtacaagttgaatgacaattcaaaatctgacgagcatgttgatgttcgagttgatggcttaatgctaaagtttgtcattccttctgaagtgaaatctgaatgtcatcaagatcagccacgtgcaatttctattcagagttctgaaatgattgccacaaatacaaggcactgtccaaactgtcgacattctgacctagaagctttgtttcaagactttaaagattgtgatttttttagtaaaacatataccagcttccccaaatcttgtgacaattttaatcttctacatccaattttccagagacatgctcatgaacaagataccaaaatgcatgaaatttataaaggaaatattactccccaattgaataaaaacactcttaaaacttctgctgccacggatgtttgggctgtgtacttttctcaattttggatagattatgaagggatgaaaagtggaaaaggacggccaataagttttgtagactcattccctctttccatttggatttgtcaaccaacaagatatgcagagtcacaaaaagagccgcagacttgtaatcaggtatctctaaatacatcacaaagtgaatctagtgatctggctggccgattgaagcggaagaagctcttgaaggagtattatagtacagagtctgagcctttgacaaatggtggtcagaagccttcttcatcagatacatttttcagattttccccttcctcgtcagaggcagatattcatctcctagttcatgttcataaacatgtcagtatgcagattaatcactaccagtatctgcttctacttttcctgcatgagtcacttatcctgctttcagagaacttaaggaaagatgtagaagctgtaactggcagtcctgctagtcagacatccatttgtattggaattttacttagaagtgcagaactggctcttttgctccatccagtggatcaagcaaatactcttaagtctcctgtttctgaaagtgtgagcccagtggtacctgattatttgcctacagaaaatggggattttttgtcttcaaaaagaaaacaaattagtagggatataaatagaattagaagtgtaactgttaatcatatgtcagacaacagatctatgagtgttgaccttagccatatccctttaaaggatcctttgctttttaaatcagctagtgatacaaatctgcaaaaaggcatttcttttatggactatttatcagataaacatttagggaaaataagtgaagatgaaagtagtggacttgtttacaaaagtggctcaggagaaattggatcagaaacaagtgacaaaaaggattcattttatacagattcaagtagtatcttaaactacagagaagattcgaatatactttcatttgatagtgatggtaatcaaaacatactttcaagtactttaactagtaaaggaaatgaaaccatagagtccatctttaaagctgaagatttgcttccagaagcagcttcactctctgaaaacctggatatcagtaaagaagagacccccccagttagaacacttaaatcacagtcatctttaagtggaaagcctaaggaacgttgcccacccaacctggctcctctctgtgtttcttataagaatatgaaaagaagctcttcacaaatgtcattggataccatttcacttgacagcatgatattggaagaacagttattagaaagtgatggaagtgatagccatatgtttttggaaaaaggaaataaaaagaactcaactacaaattacaggggcacagcagaaagtgtgaatgctggtgcaaacctacagaattatggtgaaacttctccagatgccatcagtacaaattcagagggtgctcaggaaaatcatgatgacctgatgtccgttgtggtatttaaaattactggtgttaatggggaaattgacatccgaggggaagatacagaaatctgtcttcaagtgaaccaggtgacaccagaccaattaggcaatatcagccttcggcattacctttgtaatcgtccagttggttccgatcagaaagctgtaattcattccaaatcctctcctgagatttctctgagatttgaaagtgggcctggtgctgtaatacactctttacttgcagaaaaaaatggatttctgcagtgccacatagaaaacttcagcactgagtttcttacatcttctcttatgaatattcaacattttttggaagatgaaactgttgcaacagtaatgccaatgaagatacaagtttctaacacgaaaataaatttaaaagatgatagtccccggagtagtacagtatcccttgaaccagctcctgtaactgtacatattgatcatcttgtggtagagagaagtgacgatggctcttttcatatcagagattctcacatgcttaacactggaaatgatttgaaagaaaatgtcaaaagcgattcagtgctgctgaccagtggaaagtatgatctgaagaaacaacgcagtgtcacgcaagccactcagacaagcccaggggttccttggccttctcagtcagctaactttcctgagttctcctttgacttcactagggaacaggtaatgggaaacctaattcagattcagcttcagcaattaaataactaggtattaagatactaatagttaaaacattgtttacttattttaataaaatgtaccgagtgcttgttattgtgcccaggtgctttgctaggtgctatggttagagtgttgagcaaaaaataaagaaaaatttaataccttct

SEQ ID NO: 7312 - DNA, 1794 bp, Homo sapiens
ctcttaggtgatgctgcagccaagatggcgcccgcggcggccgtggcggcctgagcgtgatgctccgggttctcggcggcggctgtggccttggccggggccttgggtctctcccggtcgtgagcgatcagcgcctctccgccggccgggctagccgggacagagaggagacggccacgaagagaggaggcagtgagcaacaggacgagaccgcggcgtctccagcctcggtaccatggccgggatcatcaagaaacaaatcttgaagcacctctccagatttaccaaaaatttatctcctgacaagataaatctaagtacccttaaaggagaaggtgaactgaagaatttggagttggatgaagaagtactccagaatatgttggatttgccaacatggcttgctatcaacaaagttttttgtaataaagcgtccattaggatcccatggacaaaactgaaaacacatcccatctgtttgtccctggataaagtaataatggaaatgagtacatgtgaagaaccaagaagccctaatggcccatcaccaattgcaactgcttcaggacaaagtgaatacggctttgctgaaaaagtagttgagggaatttctgtttctgtaaattctatagtcatcagaattggagcaaaagccttcaatgcatcatttgaactttctcagcttcggatctatagtgtaaatgcacactgggaacatggagatttgagatttactcgtattcaggatccacagagaggagaggttttgacttttaaagaaataaattggcagatgataagaatagaggcagatgccacccaaagttcacatcttgaaattatgtgtgctcctgttcgattaataaccaaccaatcaaaaatcagagtcacacttaaaagaaggttaaaggactgcaatgtcatagcaacaaagttagttctaatattggatgacttattatgggttttgactgattcccagttgaaagctatggtacaatatgcaaagtctcttagtgaagcaatagaaaaatcaacagaacaaaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtaggttcacctcctaaatccccaacacatgcctctccccagcacacacaaacagacacatatgtagtaggacggacagatattaaaagagggattacagacacagtgtacattttagaagtgtaaaacaaggggatttccccagcttggtttcttcccagttcatcctcactttgtgttcctttcctggcttttcagcatggtcatttagccctgctttagcttgggtgtcatcgcaaacttagtggggcctggccccctggtcatggtgggaatatgaaaaggggaatatggtatagtgtaaaggacactgggacttaggaatg

SEQ ID NO: 7313 - DNA, 385 bp, Homo sapiens
ccccccaacacctgtaatacacatagcttttccaccagataataaatgccttgagaactgattgagtgctttgtgttcttttttggcatttgtctttttagacctgtagagaggcacttaaatgactctgctcactttttactttcttcctaaagaaaaatgaaagagaaaataatcttaaataatactttaataatatacgtagaataaataatctaattgtttatattttaacgtttttattagtccctggataaagtaataatggaaatgagtacatgtgaagaaccaagaagccctaatggcccatcaccaattgcaactgcttcaggacaaaggtaagctacttccattaatctgcatgactgccaataacaggacatta

SEQ ID NO: 7314 - DNA, 531 bp, Homo sapiens
ttttttttttttgattcagagtctcacctcactctgtcacccaggctggagtgcagtggcgcaatctaagctcactgcaacctccacctcccagaactcaagcttaattctcatgcctcagcctaccacgtagctgggactacagacacacaccacaacactaaccaccatgcccagttttgttttgtttttgtttttgtttttgtatttttagtggagagaaggttttgccatgttggccaggctggtctcgaactcctggcctcaagtgatctgccagccttgacctcccaagtgctgggattacaggcgtgagccacggcactcggcctcaaatctacgtctttattatcatttctctatctgatctattagattattatgagattctgtcaaatgatttcctgaaacgcagacttcctctgtgtctattataccggcctaatctgccagcctggcaaatcttatgaaaaagaaaattagagttgggaggaacttgagacagtcttctggggtactgataatgttaca

SEQ ID NO: 7315 - DNA, 480 bp, Homo sapiens
ccatatagcttttttaataaagttttatggaaatataatttatatagcataaagtttactcatttaaagtatacaattcagtgacttttaatatatttaccaaattgtgtagctggcaccacgatctaattttagaacattttcctgatcccaacttctgtagctgtttaaaaaatatttcaagattaatcaaagattgatactatatttagttgatgtgattctttggtctcctttaatctggaactgttccctgcctttttcttccttgcttgacatttgtatttttgaagcttctaggccagatatcttttagaatgccccatacaatgcatttctttaatcattatttatcatagttaaattcaggttaaacgtcttggccaggaaaaaggtagtctcaatgtaggagacattgaagaggcatttgagatttttaagcaccatcgtgcactaggcccggtaacgaaaaaaaaaaaa

SEQ ID NO: 7316 - DNA, 828 bp, Homo sapiens
tatatagttctgatatgtcagttataatatctgttgatttaattatcaaacctcaatgtaatggttatgagcttttaatatttctttcccatttacccgaaagctttaaattacatttctttgatatgacagaaaataggaaatggaaactaagagattagaattaaaacatatttactatcatagctttaatataaccatggttacattgtttaatgcacacgtaaaagtagccagggacagctgggtagcctgaggttcccatgctaggaaggagagcatcctgctaaggattggagtttagagacacacgaatgaaagtatctgtcaggatggaatgatctagatatgatggccgtggatcttcattgatagagaaactgtcttctgtattaactgacaggagaaaagtgaagaaaagcaaaggatattcaaatgacagataatttggctgcataagggaagaatagttctaacttcaaatccagccctttcatatctgtgtcttaatgttgctccatgttttatgccaatcaaatttgataacatgaactaagattttttataaggtatagtgtatggaaaaataatacagccttattcttaggtatcaacagactattaaacaaactgtaatcataagatatgaaattgggttatttattacagtgataaactgctgaacattgtgtgaaaaacgtaggatagttttgcattaattttaagtttttataaattctataaacattgggatttattaaaaaacagtgttttaactgatgatattctgttggaattttctagcaataaatgggtgttttgttcaac

SEQ ID NO: 7317 - DNA, 243 bp, Homo sapiens
aaagatcaaatgacacggagacagagagaaagacacaaagagacgaagacgggagaaatagacaagaaagtgaccaaaaagagagacagacactgggcatggtggctcatgcctgtaatcccagcactttgggaggccaaggcgggaggatggcttgaggccagaagttccagacaagcctgggcaacacagtgagaccccatctctaccaaaaaatttttttaaaaaattagccaggagtgg

SEQ ID NO: 7318 - DNA, 409 bp, Homo sapiens
agaaggaagtgagaatatgaaataaaggaacattaaaataaaatgatgttaggaggagagaagacaacattcagtagtcttgagaactgtatgtttaaatcaacccaaaatatattcgagactgtgcttaaaatatacctaacaatggaagaggaggttttatattttaatattcagcttgcataggacagaggtgtgctatgtttagaagacagtatagcagaactgttaagagcacacttttagaatcactgaaacaaaaattctgatactagcatttatttagtgtgcaataacaggaggattcttgacttccctaagcctctgctttcttatctgtaaaatgggaattattatagccaactcctcggggtactttcaatatgaaactagataatgttaacaaaaa

SEQ ID NO: 7319 - DNA, 496 bp, Homo sapiens
ctaccttcacgggacctttggaagatggacatgtaagtcactgcagtgttgggacttccaggatagagtctgcaacattgcttgaagcacagagaggagatctaatagccgggagaaaaggagtagagcagatgagggttctaggcatcagcaaagatatggtgccttgacagggactggcccacctggagtgtgaatgtgatctactaaggcttaagtttgcttgcagtgtatgtgtgtatgtctgtgtgtgcatgcacgcacatgtgcacatgcagcagggagagtggaattaaggtgaaagagtagtggatttctaagaccttgccaaagaatctgaacttcatcccaaaagtcatgaacttcagaaagattttaagccagagaagaggcatgataatatctatattaaaaagacaatcaggtagcaagtgtggaggatgcatgggagagggcaaagggagaggagggaagatccgctaggaggtggaggcaa

SEQ ID NO: 7320 - DNA, 495 bp, Homo sapiens
ataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaa

SEQ ID NO: 7321 - DNA, 622 bp, Homo sapiens
aatgtgtgctctaagctcttaaaacagctctgcctcaggaaagactgtccagggcataggaagcccacacacagggtgggatgacaagtttgcatctggcacggctgggagccctggggcgctctgcccttttggccgcgttgtctcctggcttttagggtggtgggattctcggctctgattgcagcaggtggattcacttagctctcctccccttttagcattactgtcttctgtaataaacctctcactttgatctgccaggctgtcaaatgctttgattgccctctctgttttgttccaatggttcatcaatccaaatatccacaacacaaggacagattttagtctcttcatacagtgggatatttcacagctattaaaacaaatcaaataaatgcttgtgtattgatatgcaaagttgtcctgcatcaataacttttaaacacattttatgatcccacatctatatctatacataatgtttgccactgcttaaacaaaacaaaatctaagctttagactccaaatggaattacaggggaatcttgatgtctgtgttctgcagttctgtcatgtttgaaattgtcaaataaacatggtgcctttccagtaaaaaaaa

SEQ ID NO: 7322 - DNA, 285 bp, Homo sapiens
gaaatgtggcacatatacacatggaatatgattctgtcataaaaaataaaatcctgccatctgcaacaacattaatgaaactggaggacattatgttaagtgaaatataccagacacagaaagacaaataatgtatgatctcacttacatgtggaatctaaaaaagttgctatcatagaagtagagagtgcaacagtgattacccagagactggggagaggatggggatgggaatgaggaggatggggagaggttggttaataggtagatagaaggaataagttc

SEQ ID NO: 7323 - DNA, 498 bp, Homo sapiens
ttggaataaagatgtattccaaagatgtaatccaggctggatttgtaattctatattcattattattttattcatttttttccctgattttaaaaggaatcaaaatgaaaacatattttgggccctgggcacggtccctactgggcctgatggaggcggcaactctctggctggggtcggggtgacggatgcttgagccagggaagcaggaactggtgaggaggggtcggcttgggggtgagggtctccaggggatggcagagccacccaagggatgtgaggatctggaaactcagatcccatcctttaggtccagatcacagattgaaattaagtaagaatcatcaatttctatgaataacaaaagtaataataatgagtatgaatgaatagcacactctgctttgactgtcctgacccccttggcattcttcaaaagcctccaagcaaaaggaaaagaaactgccaagcacattccaggctcagggccttcgcctt

SEQ ID NO: 7324 - DNA, 482 bp, Homo sapiens
agtggtgcacgcctgtaatcccagctactcggaaggttgaggcaggagaatctcttgaacccagaagtggagtttgtattgaaccgagattgcaccactgcactcccgcctgggtgacagagtgagattctgtctccaaaaccaaaaaaagtgatggaagtattgttaatttatagaattattattggtacttttaggtaaatagttcaaatatcaaaaataaaagttaacctactgttagaattcaagtaagatgtataattttaaatcaaaagcgggcaggattaacttgcagcttctactcggatggacaaaacagtgtgtggagactcacatcgtgaacttttgcttcaagaactaccgcaggaacataacagtaaaaccgaaattattcacagaccctttgaaataagcggcttgtcgctgcaaattccatgagacagccaaaagctgtgagtgcccaaagtgaagagggggaaagt

SEQ ID NO: 7325 - DNA, 794 bp, Homo sapiens
cctgggttcacatccagcttggccgctcactgtcatgacaagtggacagatgccccgggctcagttgacccatctgtaagtggggccacgcgacacacctctgtcacagggctgggtgtggggtgaacaggctggtccctggaggcaagtagtgtggtgccctgaggcctgaggcaggctccaggaccgctcaaggaacaggggatttgaggcaactcagagaggacaggcccagcagccggccccagcctgatatcttccctccgctcaggccccagacgcagctgcatcctggagtccttctgagaaatgtgggacctgccccagctccaccccaggtgaggggcaccagccagctccagagctgcctaccttccctgtcaggtgcacaggtcagcgccaggccaaccccagagcgagaacacctgtgctggactgagctggagcagcagggtggcctgcaccggggcagcgagggaggcgttggatggagccaccccacggctcctctgtgaaggtctgcacgtcactcagaaagttgaagcaaaccaagcagggttggagcccacagttcacagccggctgcacaggggatgcaccaagcacagtttcctatgacaagtggaaacctgtgcgccacagcaaaactccgtcaccacagcagcagatggctccgaagaagtggagcgttttcatcaggttcaactttgaaacctccaccatcaccatcaccagcaccgctgtgtcatgctgataacttgaggacaggcaggacaaggccttctggcggccgc

SEQ ID NO: 7326 - DNA, 666 bp, Homo sapiens
cctgggttcacatccagcttggccgctcactgtcatgacaagtggacagatgccccgggctcagttgacccatctgtaagtggggccacgcgacacacctctgtcacagggctgggtgtggggtgaacaggctggtccctggaggcaagtagtgtggtgccctgaggcctgaggcaggctccaggaccgctcaaggaacaggggatttgaggcaactcagagaggacaggcccagcagccggccccagcctgatatcttccctccgctcaggccccagacgcagctgcatcctggagtccttctgagaaatgtgggacctgccccagctccaccccaggggcagcgagggaggcgttggatggagccaccccacggctcctctgtgaaggtctgcacgtcactcagaaagttgaagcaaaccaagcagggttggagcccacagttcacagccggctgcacaggggatgcaccaagcacagtttcctatgacaagtggaaacctgtgcgccacagcaaaactccgtcaccacagcagcagatggctccgaagaagtggagcgttttcatcaggttcaactttgaaacctccaccatcaccatcaccagcaccgctgtgtcatgctgataacttgaggacaggcaggacaaggccttctggcggccgc

SEQ ID NO: 7327 - DNA, 647 bp, Homo sapiens
cctgggttcacatccagcttggccgctcactgtcatgacaagtggacagatgccccgggctcagttgacccatctgtaagtggggccacgcgacacacctctgtcacagggctgggtgtggggtgaacaggctggtccctggaggcaagtagtgtggtgccctgaggcctgaggcaggctccaggaccgctcaaggaacaggggatttgaggcaactcagagaggacaggcccagcagccggccccagcctgatatcttccctccgctcaggccccagacgcagctgcatcctggagtccttctgagaaatgtgggacctgccccagctccaccccaggggcagcgagggaggcgttggatggagccaccccacggctcctctgtgaaggtctgcacgtcactcagaaagttgaagcaaaccaagcagggttggagcccacagttcacagccggctgcacaggggatgcaccaagcacagtttcctatgacaagtggaaacctgtgcgccacagcagcagatggctccgaagaagtggagcgttttcatcaggttcaactttgaaacctccaccatcaccatcaccagcaccgctgtgtcatgctgataacttgaggacaggcaggacaaggccttctggcggccgc

SEQ ID NO: 7328 - DNA, 779 bp, Homo sapiens
taaacatttatggagcaactgaaatattcaggatagaatgtttaaattagcgctggtctctgccttccttcctgcctgtgtgtttctctgttttgtaccctagcccattccggcaacgactatagagcatcacacttatcagatgatgtcataccgtgcccggatgaaagctagttctcaaggcactcagatcatgggcacaaaacaaagaggaaagatgtgtctttaagtcattcatttaggcactataactgcattttcagaggggaacttctatccatgtttattctcaagattgaaggactcagtgcagctctcgtggtgacagattggctcttcttgtgtgttttttctcttgctgtttagacgtaaggaccccttttctcccacctcaacatggctacatgtttgttatttcatgataatttttaaaaaaatcataagtgaaccttcacactgttagaattatttaattgtaagtgaatatcttattagaattatttttaccctgcaagactactcttttatgtaacaactgtctaatgacaaaagtggtaattatatactttgctacctacaaatgataggaaaacagagtaagctatttctggggccctctctgccactcattctgtgaggcctccatcacatcacctgacccctcacatccacagctttcctaatctttaacatgaacaggttgaagttgaggatccctaatttcccttccagatccactgttctgtgattctaggtatgtgtaacccagctatttaaaa

SEQ ID NO: 7329 - DNA, 286 bp, Homo sapiens
gacagtaagtttgaattatacttctacttttaactaagtggaatgaatgtatttatttgaacatggctcttgatatttttattggttttgtttctttgaaatttcagaaaactttagtgttgaagttttcagttcgttaaaatttacttttaacttacttttaacacctttcttatgaacaatttacctgacaatgagactgttctaatattttaaaaatattttttcatatttaaaagttttgtttgctgatttggaaatctaaaatttttacaaactggaggga

SEQ ID NO: 7330 - DNA, 1092 bp, Homo sapiens
gttacaggcatgagccaccgcgcttggccagaagtggcattcttaaattcaagaaattgggatggggagtattcacacattttataacccagaaattcaagcaattctggtgactacaaatgcattgttttggagaatagttgtaaggtggaaaaagaattaggaactcgacagatagtgagttttaactttaaataacaattcttcttttgttttgttttgtttgagacggggtctcgctctgctgcccaggctggagtgcagtggcaggatcacggtttattgcagccttaacctcctgggctcaagcagttctccctcctcagcctccagagtagctgggactataggcaagtgccaccacgcctgactaatttttaaattttttgtagagatggggtctcccatcttgcccaggctggccttgaactcttgggctcaagcaagcctcccacctctgcctcccaaagtccaaggattacaggtgtgagccattgcccccagccagtataacagtttgtgtgtgtgtgtgtgtgtgtgtgtgtgtgtgtgtgtttgacacggggtctcattctgttgcccaggcagtagtgtagtggtgcgaccatggctcactgtagtcttgacttctcaggctcaagtgatcctctcacctcagcctcctgagtagcagcggttacaggcatgcatcaccacacctggcttatttttaaaacttttttgtggagacagggtcttactatgttgccatggctggtctagaacttctgggctcgagtaatcctcctgccttggcctctcaaaatgttgggattacaggtgtgagccactgtgtcataacaattattttaaaatttttatttatttatttttaataattatacaagatggagtctcactatgttgcccaggctggtcttgaatgcctgggctcaaatgatcttcctgccttgaccccccaaagtgctgggattacaggcgtgagccactgcgcctggcctataacaattcttatgaagctaaagttgatttggattttagctgccgttactacttatataattaattagattaaacaagtcacaaaaattg

SEQ ID NO: 7331 - DNA, 1308 bp, Homo sapiens
gttacaggcatgagccaccgcgcttggccagaagtggcattcttaaattcaagaaattgggatggggagtattcacacattttataacccagaaattcaagcaattctggtgactacaaatgcattgttttggagaatagttgtaaggtggaaaaagaattaggaactcgacagatagtgagttttaactttaaataacaattcttcttttgttttgttttgtttgagacggggtctcgctctgctgcccaggctggagtgcagtggcaggatcacggtttattgcagccttaacctcctgggctcaagcagttctccctcctcagcctccagagtagctgggactataggcaagtgccaccacgcctgactaatttttaaattttttgtagagatggggtctcccatcttgcccaggctggccttgaactcttgggctcaagcaagcctcccacctctgcctcccaaagtccaaggattacaggtgtgagccattgcccccagccagtataacagtttgtgtgtgtgtgtgtgtgtgtgtgtgtgtgtgtgtgtttgacacggggtctcattctgttgcccaggcagtagtgtagtggtgcgaccatggctcactgtagtcttgacttctcaggctcaagtgatcctctcacctcagcctcctgagtagcagcggttacaggcatgcatcaccacacctggcttatttttaaaacttttttgtggagacagggtcttactatgttgccatggctggtctagaacttctgggctcgagtaatcctcctgccttggcctctcaaaatgttgggattacaggtgtgagccactgtgtcataacaattattttaaaatttttatttatttatttttaataattatacaagatggagtctcactatgttgcccaggctggtcttgaatgcctgggctcaaatgatcttcctgccttgaccccccaaagtgctgggattacaggcgtgagccactgcgcctggcctataacaattcttatgaagctaaagttgatttggattttagctgccgttactacttatataattaattagattaaacaagtcacaaaaattggatgagctatcttggtgtgttttctttacttttctctttcaacagagagttgaaggagaggacaagtgtcttgtctgtggcttccaggaatgtgtggcaatataagatttactgttacagcagccaactcaccaagtcattatttgacttactgagttaaggaggaactaagggtcattttccccccatcatttgcatgttttgactcctgaactg

SEQ ID NO: 7332 - DNA, 353 bp, Homo sapiens
aactgcttgcccaaacacaaatgtctgtgccatcagactgcagatgcattgtgactgtaatctcttgagaaaactcctaagaggacccctgtactgtctagaagactatttagtttcactgatattcataataaagtctataatcatgtactctggaccaacatcagagcatcacctgaaagcttgttagaaatgcgtaatcatgccaggaataggtacagttctgctggatcggctgggcgccatggctaacacctataatcccagcactttgggaggcagagacgggcagatcacctgagggcaggagttcaagacaagcctggccaacatggtgtaaaccccatctctac

SEQ ID NO: 7333 - DNA, 405 bp, Homo sapiens
aattttatttaaagcttagaacaaaaaaattaatctgaatgtgtatttataattgcaaggctccttaatcactttacgcgcacggggtgaattcttcttatctggaaagcagcattaatcctgcagaatttaaaatgaattatgactccttatcacaagagtatgatttttcttcctgtctttggttaaaaaaaagtttgtagggttagaatttgatcctctaaattgtggtttaattgtgaaagtagatagcaaacattcatggtttccttaatagttactcatctgacaaactacacctatattcatcttcgttgatgtaatgataagtcttgaaatgtttttaaaaaatttcacaattcccaaatgaaacacttacagcaacttgactgaggttagtgctac

SEQ ID NO: 7334 - DNA, 906 bp, Homo sapiens
agcacaagctggtcaggagattgcaggctccacacctgccttagtggtagttccatcagtgcagtctgcaaagtcagagggaagcagattggccagaatgcccaggaggtcacagatcaggagaattgggaggggaaagagccttggacttggaggcaagcgatctgagtgatgacctggggtatgccgcttcacctctactggccttggtttccctgcaaaatggggaacgtgttccctgctgatcgtgtgaaaagagtgagacaaccagtttagagtgctctgaaaacatgcaagtgctagatattacagcccagtaaaacctcctttatctagttgggatggcagccagtctgaataataaaatacaaatacatgtgctattatttctttcctgtacagagcgtattttatagtatttgctaagtagaagtctttaggggaatcagtttgaagagtgaagagtaattagtaaccggtgtatcagttttcatcctgttccagcagtgcctctggtacttaaaaaacagtttattctttttgaattaaacttgttaacatcaattatgtgttaatcagatcctttttacataatacaaaagtaaactctggctttgttttttgttaaaaaatgcctaatgggcccttctaattattcagatttaaaaaaatctttactagcgccccagcaagggcaccttttccatgtagaagaatccaaagtccttagggcccttattccctctctcactgcccagtttcttcacttccaacccctgctgcaattccgtttctccttctctgagcctaagctgctaagtgcagctggagtaatttgcataaccatctcgcccggccctcttccttcatgggttgtggatgcaacagagtctgcaacacttcaag

SEQ ID NO: 7335 - DNA, 365 bp, Homo sapiens
atttttttaaatctgaataattagaagggcccattaggcattttttaacaaaaaacaaagccagagcttacttttgttttttgttaaaaaatgcctaatgggcccttctaattattcagatttaaaaaaatctttactagcgccccagcaagggcaccttttccatgtagaagaatccaaagtccttagggcccttattccctctctcactgcccagtttcttcacttccaacccctgctgcaattccgtttctccttctctgagcctaagctgctaagtgcagctggagtaatttgcataaccatctcgcccggccctcttccttcatgggttgtggatgcaacagagtctgcaacacttcaag

SEQ ID NO: 7336 - DNA, 240 bp, Homo sapiens
gcaccaagtatagagatatcaggcatagagaagggcaatggtgatgtgccataccaagaataagaactaaatgagaatctgcatactgaaggatagatctcttccctacccatctgccttctaattccagaaccacagaaaccaggatcatttccacaatcatgagaattaaaagattcttctctgtagaagcagaactgtccccagagaaaagaactacagatactacagctataatta

SEQ ID NO: 7337 - DNA, 341 bp, Homo sapiens
actttatataccttcatttcgtcctttcagaaaaggaacaaacagagctgggtgcactggctcacgcctgtaatctcagcattttgggaggccaaggcgggacgatcacctgaggtcaggagttcaagaccggcctggccaacatggcgaaaccccgtctctactaaaaaatacaaaaattagccaggtgtagtggtgtgcacctgtaatcccagctacttaggaggctgaggtgggataattgcttgaacctgggaggtggaggctacagtgagctgagatgtgccactgcattccagcctgggcaacagagtgacactctgtttcaaaataaaataaaa

SEQ ID NO: 7338 - DNA, 321 bp, Homo sapiens
gccaataggtggtgtattagcatcactcatgctgctataaagaaatacccaagactgggtaatttctaaaggaaagaggtttgattgactcacagttccacatggctggggaggccttgggaaacttacaatcatggcagaaggcgagggagaagcaaaggtgcatcttatgtggcagcaggcaagatcgagtgtatatcagcacagaagaaactaccttatataaaaccatcagatctcatgagaattcactcactatcacaagattagcatgagggaaccgcccccataatccattcacttcccacccgctctctccct

SEQ ID NO: 7339 - DNA, 426 bp, Homo sapiens
ccatccacggcttgggctgatgtaaccaggaagtattccaatgatgtgaattattaatgtagaataaagtaagagaggaagtattcagtgaaggggtgaacgtcaacacagatccccaaggatctagccatgtatttgctgtgaaattcacactctgtgtgactactaaagacagttcagctactcgtacttcactccatttcctttgtgaaatctgaagaactctaggtgaatcaggtgatggttgtaaaaaataatcatcatcttaaaatctttaaagcactttttacaacacaaatagcattgttgccatagaagattaagttttaaaaagtgctttatctaaatgatgtttcccctttttcctttccagttttcctctccaattgtgatgccattttacatctataatgccacatattctta

SEQ ID NO: 7340 - DNA, 594 bp, Homo sapiens
ttttaataaggggacatatagttggaattaaaatttagatctttctgtacaaagcttgtttggtgttgtgtcctatatgtatttgtttatttttgttcattcttaacaaatatctattctctgccagacactgaggatacaatgcaaattaaaaaaactaaactgaaaatacaggctttctgttcttagaccttattctccagtacgagaggacaggaatggatttcaaatgggcctgctgggaaattttgggaaattgacctttactttacataatttgctgtaagcactgtagtaatgtggtaacattattttgaacttggtgagaagacgggcataccggtagattttctaaagcaggtaggaataaagggcatgaatatattaaaattccctgtgagtttgacacagatcttaacttcaagagtttaatagtttaaggatcttagcttaagaattcttagaaagtaggctgggtgtggtggctcacacctgtaatctcagcagggagatgtgggaggccgaggcgggcagatgacttgagcccaggagtgtaagactagcctgggcaacataacaaaaccccgtctttac

SEQ ID NO: 7341 - DNA, 358 bp, Homo sapiens
gataatcgattataataccgtaaaatgctaattgtagatgatggacatatgtgtatccacttcccaattctttcaactttccgcatgcttgaaaatacaaaaatggtaaggaaaatttttacaagcactgggagacaaaaacaaaagtgataattctgttggtggtaaaagtttctctcatttgatgttacacacctcactgcttcacaaaatacactacctttggaactcgttaaaccaataccccaatcacctactgtccctggggaaactgataggtacatttcaggaattgttgtttcctgtcaccaactgttcacgttgtttgcgatcttcagagattaagtcagtaattatg

SEQ ID NO: 7342 - DNA, 196 bp, Homo sapiens
gaaaactgagacaaacagaagctaaaagacaaagtcacagacaaatcagtcattgagctgagattgaaagccagttctctcaatccctgcaacaggcctcttttcacaccacactatctccattttttagaacctgcttctattaaactgccgattatctattcaatttatttccagcagtagttgtaataaatct

SEQ ID NO: 7343 - DNA, 425 bp, Homo sapiens
tcaatttgcaatttcagagagaaattgcaaaaggtctatgagaccgaatttttttagtggtgtgtttataaacttagagcactgcgtgggactgagcaggggccagggaagaaaatgacgttggtaggcgttctttggcctgaacatttctaggtatttgttacatggactgttttactttcacacccgtctgtgagaggggaattattgcctcctctcttagaggaaaccgaagctgagactaagtgatgatacgaaaggccttccttcagtaaggggtagagccagggctacacaaattggttctgtgacagaatggactacgctggtgctggttttaggctgcctttcatttgtgaagatcacataactgacgcccttcctgagagttaaataggtcttagtttaagctgttcttttgagaa

SEQ ID NO: 7344 - DNA, 343 bp, Homo sapiens
cagagagtcacattgagaatcctggacccagagcagtagaatctgtaacaactgagaaaattcttctggcaagaacgtgtgctcataatgagttctcactacacctggagctgacccctagcaatcatgaatgaatacttgaactcctctgccatctctggttctctaaaaggaaaataaaacaagagagaaaagggatagaaggaggaaaggagggaagagagagaggagcaaagaagaaaaactgagccaaataaattctgactctgctttgtagctttacacttatttatttattagagacacagtctcactctgttgcctaggctagaatgcagtggtg

SEQ ID NO: 7345 - DNA, 582 bp, Homo sapiens
tgagctgtaaccagaaagacatcaccgaatttaccattgaaatgtcttcatttaagtccgtttctcaacagttgttagccagatccagctggattttatatctgacttgtgatcacggtgaaagaatgcaaaaaggagacacagacttttaaaatgttctgtccagaaaagaataagaacactatctaaaaaaacatgaagttctagtaaaaatgatgcttgagacagaaaaaagaatttaaaaagatacagtgaattaactaaaaataaaagacagttctttgtttggtttaccattctccccccaaaatggagggatatttgtatatttgtatattctgacaggcactttctcttctaagggagggaagtagttagaggccctaggctccactgtagaaatgtgataatggagatgtgcagtgctctagggccaagattagtctccgagacagcattgggtgacattgttttaccgtagtatttttgctttctgttttgagttccttgttggttcacaaatgttctctttttctccaccttttatctaatcagtcacaataaaatgtaactgtcaaccag

SEQ ID NO: 7346 - DNA, 842 bp, Homo sapiens
ttgagacgatgcctcgctgtctcccaggctgaagtgcagtggtgccatctcggctcattgcaacctctgcctcccaggttcaagtgattctcctgcttcagcctcctgagtatctaggactacaggcatgcgccaccaggcccagctaatcttttgtatttttagtagagatgaggttttttttaaaaatcaaatttccaataaatgcacttcttagggacttctcagtgtggggtgcctggccctggagcacttgtggtttggaaatcaagtgtaacaagccagtagttataaagactaacaaatttgtgttccttctcctccctttcctctcctgggttaagtggaagcattaaaaattaagaaatagatcctgagccacaatcaattcctaagaagctactgtttcttcatttctggtattaaatagtaagaactacttacattgcatccattcctgcaaaaatgcactgactgtatgattaaggcacagtaagtctaacattttgtcccgatcacttttctagtattcaaaccactgtaagtaataccactatgtactctgcatctttctctgaagagctttaacagcttttatgtattacccatatcaagatacttcatggattaggaaggggcaataatatttcaatagtttcataaaattagtttcccaggactttaagtagagtttattctctaagattttagttcttcaaatatgtgaagatggtgattttaaatactttatttcaatcaattcagttcaaggatttaaattatttcaaatacttgaattagctattgtcacatgatttctcacacagaatgtgaccatctct

SEQ ID NO: 7347 - DNA, 411 bp, Homo sapiens
aacaacaacaacaacaacaacaaaccaacaataatatctatgccttggctttgctagacaacacaacagcgtgtagaggttaggaacacagactttggagccaggttacccaggctcaggtcccagcaccgcgactctcaatctcatgaccttgggcaagttacttgttccctctgtgcttcagtttcctcattggttcagtgggcaaaataagactaacataaagttattgcaaaaatggaatgagataataaatgttaagcttttagaacagtacttggcacatagtaagcactagggaagtgtttttattgttgtggttgtgagatttaaatgaatgtgtagaaaatacctagcatggtgcaaatgctcagtaaaatttttttctgacactaaattctatgctaacta

SEQ ID NO: 7348 - DNA, 291 bp, Homo sapiens
gtaactctccttcccaaacggagcccaggcttcgtcttcagtgccctgtctgaatattacaagcagttgcaaaggtgcaagctagtgtctcgagacagtgacatgaggttttcctggaaataaggaatgtcaaggaaatgtcacagtacgtcaaaactccccgtcccgtctttaagatgagacaacaagggaaggccactgtggatttgcaaataataattctgtttgagtgaaaggtggcatttctcaggttaagtgaatcccatgatttgattaaagatatttgtgttt

SEQ ID NO: 7349 - DNA, 425 bp, Homo sapiens
agtataaataatgtagttttattaatagataagtattagtaaaactttgcattagaagatgtatgactgacgttgcatagagttgtgtgatgtagagtaatattcatggtgtacacatcataattatgtttgcgaaacatgaatacctactacaggtctttgtgatagacatcagggtggggatgcataggggacaaaaatgtacacaattttgtgtctgctctcagagagattacatagtaggagaggaagacccagtattaaaaaatagaataaaggcaagtgccccaaatctttgtcattaattttgactggaagagaggcttaggaaagatgagacatttaagcattgcatggaggaaaaaagaagtagatctcccttggcaggtggataggctaggacattccaaactgagaaaaagcaa

SEQ ID NO: 7350 - DNA, 344 bp, Homo sapiens
tggcccttccttgcagccccatccccaacaatcctggtctatcaggaacatctggtttggaggtagaaggagctccagggaaagggagcttcaggatcctcagcattaatcatcaataggagaaatggaccttagtcttgaagattaaaaaagaaagttttatgttgcaaaaacgtggtgtcttcatagttactatgccaacagaaccctaattttatttccgcttcatagcaagggtcatcttctggaagagaaagagcagagaggaagataagtcatcctgccacatagatactagagtcagtctgagacaaagagagtcaaaggaaggaaatgtgcagacc

SEQ ID NO: 7351 - DNA, 322 bp, Homo sapiens
tcactgtgtgccctggcctgggtgagcatcattcttcggggagaaccttgatgaaaacaaagctgcattccaaaaagttaaaaccgtgctacttactgtactgaggtaaaaattaaaagacctaggggactcttccaaaagttaaaacgtaaataaatatcttgtaacattaatatacacctgacgatgtcctgagtgaacacgccccggtttaaaaacaaaacaaaaacaaaaaaaaccacaagtaggttattcaagttgtttgcaacatacattttgtaatgaaatgtgagaaattaataaagaatttttttcacatgtg

SEQ ID NO: 7352 - DNA, 244 bp, Homo sapiens
ggagtctcttggaggtcttgatacaacagatttttagtgcccctcctccctcccccagagtgtctgctttggtaggtcggtagtgaggcctaagcattagaattttcagcaggttcccaggtgatgctgatgcctttgctctgggaccaaacttggagaaccagtagacctcgacacatgctgctccctctgccaagtccccaccccctacaccatcagtggcatcctccctgtgcgtccccag

SEQ ID NO: 7353 - DNA, 1301 bp, Homo sapiens
gtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggctttctctttttaaagtcagactgttgaaggtttcttctattcttatttgttaagagttttcttttattgtttaaatcatgaatgaatgttgaattttattaaatgcagtttctgtaaatattaacgtgatcatattatttttattctttcatttacataattataaattagattaagttttcaatgttaagctacccttgcatttatgaaataaaccacgcttgctcatgatggtttttgaacatttataatctgtctcacagatttgtttagaatttctgtatttatgtttatgtagagatggctctgttatttcacttttctctactgtccttgttagcttttacataaaacttagttttcctgaaaggag

SEQ ID NO: 7354 - DNA, 1683 bp, Homo sapiens
gtcagatcccacaggtttaagggctcattccccaagtctgctcctccagttgagacacaagtcacaaatccaggcttctgaaacttcggaccaaccagcttcaatcagggttcccactaccccctctttgggggtagagtggctcatggaactcagagaaacatttatttcggcttgctggtttattataaaagcaaggtttattataaaagatactacaaaggatacagatgaagaggcacatagggcaaggtacggggttccacgccctccctgagtgcatcaccctctgggaacctccgtgtgttcacgtctcatgaagctctccaaatccagtcctcttgggtttttatggaagcttcatgatgtcagcattctttcctccagtgtataggatgggatcctctctggggagggtcttaagacccacaattagaaaggcaagggaagattagagtcctgctttggggtagatgaaaggaaaggagagagattctgtttcctgaggcttaatacacccaacattataacaaaggactgtagcaagggctatgggagttctgaagcagaaaccatgggctaaaaccaacatacatcttaataccagataccctaatcccagtcctaacttcatttaaccttggtcacattgagtcattccaggatgagtggctcaagtatttcctcagggaaaatacttctgtgccccctgatttgagggtaagaagtagataatgaggccactgtgggtgttattttttcatgtctggacctcagcctatatcctgagactaagtggaagtgggaaaagagtacaagagaagagacaaagtggggatatttgtaaggcttagatgagatagtgtttttttagaaaaaaactttatcttaccattaagtaaaatgtttgccataggctttctggggctttctctttttaaagtcagactgttgaaggtttcttctattcttatttgttaagagttttcttttattgtttaaatcatgaatgaatgttgaattttattaaatgcagtttctgtaaatattaacgtgatcatattatttttattctttcatttacataattataaattagattaagttttcaatgttaagctacccttgcatttatgaaataaaccacgcttgctcatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaactacaaaaaaaaaaacaaaaaacacaataaaaaaaaatactttaagggggccccctgtcccaaaatcccctatttggggggcttttacaactaagtggccgttgtttttaacacgtgcgcgcgggaaaaacccgtggtctaccccatttaaaccccttgtcaaaaatcctcttttctcacgcttggtcataaaatcaagagcccccctcctatgctcctttcaaaaagttgcccatctttctgtgtcatcgcaattttggcgcgcaattttttttaaacaccccgcttaaattttttgttaaacactttttttttcaccaattggccttaattctataaccccttttaattacaaacatcccccctaatacgcttggcggtttctcctttttcc

SEQ ID NO: 7355 - DNA, 4525 bp, Homo sapiens
  misc_feature (394)..(394): n is a, c, g, or t
  misc_feature (610)..(610): n is a, c, g, or t
  misc_feature (949)..(949): n is a, c, g, or t
  misc_feature (1133)..(1133): n is a, c, g, or t
  misc_feature (1149)..(1149): n is a, c, g, or t
  misc_feature (1415)..(1415): n is a, c, g, or t
atctttgaagaggcactagcatcagacctcaaggcttttgtcccaccaaagatagtgggggagtttttgaacccttgtgggagcctggtccaggtgaattgtgttcctccccattggaatgcaaaaataggctgactcattggagctagcctgaagcagaaaaaggcaccttttaagtccaaacaggaaaaccaggcagcatgagcaggaatgtggctcgtcattgtatacgggttcaaaaactcccccactatctttgaagaggcactagcatcagacctcaaggcttttgtcccaccaaatgacaagtgtgtattgttacaatacattggtgatcttttgtttgcggcacctaccgaggaagattgcttccagggcaccaaagatctccttngccttctatggaaggcaggttacaagatgtctaaggaaaaagctcaggtctgtgcaaaaagagtaagatatctaggtttcctagtagcccaagggcagcgtgaactcggcagtgggcagaaggaagccatatgtgcgctccccactcctgtcacccggcgacaagtaagggagtttttaggggcagcaggcttttgctgtacttcaatgccaaacntttcactcacggcaaagccattgtatgaagccacaaagtgggggagaaaaagagcccctcctctggggtaatgagcagaagaaggcctttaatgagatcaaaaaggccttaagccaagctcgagccctgggattgccagacctgactaagcctttctttttctatgtccatgaaagaaaaggaatgactacaggagtttcagttcaaacagtaggatcatggtattgaccagtagcctatttatcaaagcggttagaccttgtggccctgggtggcccccctgcttaaaagcattagctgccactgccatgctggcagaaaatgctggaagctgacacnaggacaaaagctaataatacgggtgccacacacagtgatcaccttaatggagcaaagaggatatatcactggctatctaatccaagaatgttaagatatcaggggctcttatgtggaaatccatacgtaactttaaaaaccgcgaataccctcaacccggctaccctgttgcctgtagaaatgncgaagttgcaagaccngtttccccaacgctattgcgtagacgtagtagatgaggtgttctcaagccggaaagacttaagagaccaaccctttaaggacccagacgctgaatatttcacagagggaagcaggtttgtatcagaaggggtctgcagagccgggtatgcagggtgactctaaattcagtagccaaggcacaggccctccctaccaggacctcagcacaaaaagcagaatagctctaaatagagcactactagtagccaaaggaaggacagttaanatctatactgattcaaagtatgcttttgctacattacatgcccatggagccatttacaaagaaaggggactcttaactgctggagggaaagaaattaaagaagaaatcttacaactcttagaagctgtgtgggccccagacaaggtggccgttattcactgtaaaggacatcagacaagaggcggcatagaagcaaaaggaaataggaaggcagacagagaagccagacaagcagctatgtccaactcaagtactaaaaagaaaaccccaaccctgctgcttctactagaaccttccttacctgaaaccccaagctactctcccaatgaaaaagcttggtttgaacaagagagcggaagttacatacaaggaggcaggtggaagttctcagatgggaggctagctattccggaagcaatagccccccaatttatgaagcagtttcatcagggaacacacatgggaaagactgcattagaaactcttgtaggatggcatttctatgtgccatgccttactgccatcactcgagccgtttgtgagcaatgtttaacctgcgcccagaacaatccatggcaagtgccaactcagcccccagggattcaagagaccggagctacaccctgtgaaaacttgcttgtggactttaccgaactgccccgagcacggggttatcagtacatgctagtgtttgtttgcactttctcagggtgggtcgaggcattccctaccaggatagagaaagcccaagaagtaaccagactgttgctaaaagacattattcctaggtttggactgcctctaactttaggatcagataatggcccagcattcatggctgaagtagttcagcagctgtcgcagctgctaaagataaagtggaaactgcacatagtctaccacccacagagctcaggaaaggtacaatggatgaaccagacactaaaacatctgctgaagttttgtcaagaacctcatcttaggtgggatcaggtcttgcccatggcctttctccaagtcaggtgtacccttaccaaattgactgggctttcaccctgtgaaattgtgttcggccgaccacccccgattataaatcaggtaaaaggtgatctgtgggaactaggggaactaactttaaaaaggcaaatgcaagctttaggattagctatgcaaaagattcatggctgggtacgagaaaaattgcctataagcctaacagacccagttcacccctttacacctggggacttggtttgggttaagaaatggaacccaaccacactagggcccatatgggatgggcccacactgtaatcttgtctactcccactgctgttaaagttgcaggtatcacaccttggattcatcacagtcgactgaagctggctgcgcaggaccagtgaaccagtcaacaagactcagaccatccaacatgactaatcctgtggcaaaaccacgacaccactgagaaagtcaaccaccctgctgtgatcactctggaggctggtcagtctacgcacaactgaagcttgagaagtcaaaccctgctgtagtcacacactggaagctgactagtctacgcatggccaaagcttgaggagtcttcactagataagtaaatgtggatagaacttataagcctagtagtgatcttagtaatactgattatcttattattatgttactgtttttgttcaggaaaaggcctatattggatctgtggagcacaggcatatcagcaactgccagctaaatggacaagagcatgtgtattaggaacaatcaagccatccttctttctaattcctctaaagcaaggggaactcttaggatatccagtctataatgagaataaaagaactaaaaggagcatgatctcaaaaataaatataaatatcaaaaaagacatagacataggagactagaaaaataatcaatggcctcctgaaaaaatcattaaatactatgggccagctacctaggcacaaaataggtaatggggataccacaccccaatttatatgctcaactgtatcataaggttacaggctgttcttgaaataataacctatgaaacatcaagagctttttgatgaacctatgaacatcaagatttactagctgtacaagctacacagataaggaatgccatatatcaaaacaggctggcactagattacctcctagcctcagaaggaggagtatgtgggaagtttaatctaacaaactgctgtttagacgtagacaataggcgagctgtcatgggaattactgccaggatgtggaagttagcccaagttccagttcaaacctggtcaggttggtctccagattctctctttgaaggatggttttcaacctttagtgggttcaaaaccttaataggtgggttcctgcttatcacaggtgcctgcctaattctcccttgtctcctacctcttctcatcagaagtgttcagtcaactatagaggcagttgtggccaaatacactactactcaaataatggcattgactaagtattgccccaagaataatatgtaccgactcaagaaaaaataaacaactgtggtgctattaaccaacatttatatagagcaccaaaggggggaatgaagtggaaaattaaaataggataatagcataagtaataatagtaaaattatagtaacagaaataatagctcatagaatgaattgctgtaccaaccaaggctaaaaagaatttaagtagcccccctgaagttagagttaaagaaggatattaactgccagtcccaagaaacattaaccatatctgcccttcaggtattttgtaggctctgtaagctcgtgttttcttccctccttgtacagctgcaaggtcacaagacagataagcataagctgcatactaagttttcccagagatgtaagacatgttgcaaaagtgtcacaagataattaatggactttgttcttgcttctgtaagcctgcttcctgcttcacgtaattcctgcctcaaaatgcttaaaagacattcgttttctttgatctatgcttagattttctggatgcaattccactgagccgatgtacacctaaaaataaaaactttcctgcatccaattc

SEQ ID NO: 7356 - DNA, 4471 bp, Homo sapiens
  misc_feature (394)..(394): n is a, c, g, or t
  misc_feature (610)..(610): n is a, c, g, or t
  misc_feature (949)..(949): n is a, c, g, or t
  misc_feature (1133)..(1133): n is a, c, g, or t
  misc_feature (1149)..(1149): n is a, c, g, or t
  misc_feature (1415)..(1415): n is a, c, g, or t
atctttgaagaggcactagcatcagacctcaaggcttttgtcccaccaaagatagtgggggagtttttgaacccttgtgggagcctggtccaggtgaattgtgttcctccccattggaatgcaaaaataggctgactcattggagctagcctgaagcagaaaaaggcaccttttaagtccaaacaggaaaaccaggcagcatgagcaggaatgtggctcgtcattgtatacgggttcaaaaactcccccactatctttgaagaggcactagcatcagacctcaaggcttttgtcccaccaaatgacaagtgtgtattgttacaatacattggtgatcttttgtttgcggcacctaccgaggaagattgcttccagggcaccaaagatctccttngccttctatggaaggcaggttacaagatgtctaaggaaaaagctcaggtctgtgcaaaaagagtaagatatctaggtttcctagtagcccaagggcagcgtgaactcggcagtgggcagaaggaagccatatgtgcgctccccactcctgtcacccggcgacaagtaagggagtttttaggggcagcaggcttttgctgtacttcaatgccaaacntttcactcacggcaaagccattgtatgaagccacaaagtgggggagaaaaagagcccctcctctggggtaatgagcagaagaaggcctttaatgagatcaaaaaggccttaagccaagctcgagccctgggattgccagacctgactaagcctttctttttctatgtccatgaaagaaaaggaatgactacaggagtttcagttcaaacagtaggatcatggtattgaccagtagcctatttatcaaagcggttagaccttgtggccctgggtggcccccctgcttaaaagcattagctgccactgccatgctggcagaaaatgctggaagctgacacnaggacaaaagctaataatacgggtgccacacacagtgatcaccttaatggagcaaagaggatatatcactggctatctaatccaagaatgttaagatatcaggggctcttatgtggaaatccatacgtaactttaaaaaccgcgaataccctcaacccggctaccctgttgcctgtagaaatgncgaagttgcaagaccngtttccccaacgctattgcgtagacgtagtagatgaggtgttctcaagccggaaagacttaagagaccaaccctttaaggacccagacgctgaatatttcacagagggaagcaggtttgtatcagaaggggtctgcagagccgggtatgcagggtgactctaaattcagtagccaaggcacaggccctccctaccaggacctcagcacaaaaagcagaatagctctaaatagagcactactagtagccaaaggaaggacagttaanatctatactgattcaaagtatgcttttgctacattacatgcccatggagccatttacaaagaaaggggactcttaactgctggagggaaagaaattaaagaagaaatcttacaactcttagaagctgtgtgggccccagacaaggtggccgttattcactgtaaaggacatcagacaagaggcggcatagaagcaaaaggaaataggaaggcagacagagaagccagacaagcagctatgtccaactcaagtactaaaaagaaaaccccaaccctgctgcttctactagaaccttccttacctgaaaccccaagctactctcccaatgaaaaagcttggtttgaacaagagagcggaagttacatacaaggaggcaggtggaagttctcagatgggaggctagctattccggaagcaatagccccccaatttatgaagcagtttcatcagggaacacacatgggaaagactgcattagaaactcttgtaggatggcatttctatgtgccatgccttactgccatcactcgagccgtttgtgagcaatgtttaacctgcgcccagaacaatccatggcaagtgccaactcagcccccagggattcaagagaccggagctacaccctgtgaaaacttgcttgtggactttaccgaactgccccgagcacggggttatcagtacatgctagtgtttgtttgcactttctcagggtgggtcgaggcattccctaccaggatagagaaagcccaagaagtaaccagactgttgctaaaagacattattcctaggtttggactgcctctaactttaggatcagataatggcccagcattcatggctgaagtagttcagcagctgtcgcagctgctaaagataaagtggaaactgcacatagtctaccacccacagagctcaggaaaggtacaatggatgaaccagacactaaaacatctgctgaagttttgtcaagaacctcatcttaggtgggatcaggtcttgcccatggcctttctccaagtcaggtgtacccttaccaaattgactgggctttcaccctgtgaaattgtgttcggccgaccacccccgattataaatcaggtaaaaggtgatctgtgggaactaggggaactaactttaaaaaggcaaatgcaagctttaggattagctatgcaaaagattcatggctgggtacgagaagtttgggttaagaaatggaacccaaccacactagggcccatatgggatgggcccacactgtaatcttgtctactcccactgctgttaaagttgcaggtatcacaccttggattcatcacagtcgactgaagctggctgcgcaggaccagtgaaccagtcaacaagactcagaccatccaacatgactaatcctgtggcaaaaccacgacaccactgagaaagtcaaccaccctgctgtgatcactctggaggctggtcagtctacgcacaactgaagcttgagaagtcaaaccctgctgtagtcacacactggaagctgactagtctacgcatggccaaagcttgaggagtcttcactagataagtaaatgtggatagaacttataagcctagtagtgatcttagtaatactgattatcttattattatgttactgtttttgttcaggaaaaggcctatattggatctgtggagcacaggcatatcagcaactgccagctaaatggacaagagcatgtgtattaggaacaatcaagccatccttctttctaattcctctaaagcaaggggaactcttaggatatccagtctataatgagaataaaagaactaaaaggagcatgatctcaaaaataaatataaatatcaaaaaagacatagacataggagactagaaaaataatcaatggcctcctgaaaaaatcattaaatactatgggccagctacctaggcacaaaataggtaatggggataccacaccccaatttatatgctcaactgtatcataaggttacaggctgttcttgaaataataacctatgaaacatcaagagctttttgatgaacctatgaacatcaagatttactagctgtacaagctacacagataaggaatgccatatatcaaaacaggctggcactagattacctcctagcctcagaaggaggagtatgtgggaagtttaatctaacaaactgctgtttagacgtagacaataggcgagctgtcatgggaattactgccaggatgtggaagttagcccaagttccagttcaaacctggtcaggttggtctccagattctctctttgaaggatggttttcaacctttagtgggttcaaaaccttaataggtgggttcctgcttatcacaggtgcctgcctaattctcccttgtctcctacctcttctcatcagaagtgttcagtcaactatagaggcagttgtggccaaatacactactactcaaataatggcattgactaagtattgccccaagaataatatgtaccgactcaagaaaaaataaacaactgtggtgctattaaccaacatttatatagagcaccaaaggggggaatgaagtggaaaattaaaataggataatagcataagtaataatagtaaaattatagtaacagaaataatagctcatagaatgaattgctgtaccaaccaaggctaaaaagaatttaagtagcccccctgaagttagagttaaagaaggatattaactgccagtcccaagaaacattaaccatatctgcccttcaggtattttgtaggctctgtaagctcgtgttttcttccctccttgtacagctgcaaggtcacaagacagataagcataagctgcatactaagttttcccagagatgtaagacatgttgcaaaagtgtcacaagataattaatggactttgttcttgcttctgtaagcctgcttcctgcttcacgtaattcctgcctcaaaatgcttaaaagacattcgttttctttgatctatgcttagattttctggatgcaattccactgagccgatgtacacctaaaaataaaaactttcctgcatccaattc

SEQ ID NO: 7357 - DNA, 517 bp, Homo sapiens
aaacaatattattacaactacttgaaattaactttctacttctgatggtattttaataccttaaaatatttgagtataaaatttattcttgttcactttctttcattgtatttatccctctgaagtacagagccaacaacagaaatgtgcagaaaacaggagataactttgaatattgacattccagctgtctttgttgagtaacaaactataccataatttctatggactgaatgtttgtgcctcccccataagttcatatgttgaaatcctaatgctcaatattatactaagatgcaatagggccattgaggtaattatgtcacaagagtgggcctaatatgaccaatcctatatcaatgagattagtgttcttacaaaaagacaccagacaggccctgagtacagtatcttaggcctgtaatcccagcactttgggaggctggggtgggaggatcacctgagcccaggagttccagaccagcctggaaaacagggcaagacactgcctctacca

SEQ ID NO: 7358 - DNA, 477 bp, Homo sapiens
ttttgtatttttagtagaaacggggtttcaccatgttagccaggatggtctcgatctcctgacctcgtgatctgcccgcctcggcctcccaaagtgctgggattacaggcattagccaccgcgcccggccaatacattttaaaagattaaaatcatctgaaaaatctccaaacacaatggcacgaaactagaaataagtaatagaaaaaaatgagaaattcataaatatgtaaatattaaataacacactacgaaaaggccaatgggtcaaagaagaaattacaaggtaaattagaaaatatttagagtggaataaaagcaaaaatacaatctactgaaacttttggaattcagcaaaagaaacctactcagagattaatttacagttggaaatgctcacattaaaaaagaacagtgggtaggaggcagagcaagatggtcaaatagaagcctccagtgattgtacccttgacagga

SEQ ID NO: 7359 - DNA, 153 bp, Homo sapiens
tataatgacattttacattatggttgcaacttttgcacttgaaactagtattctaaactatttattttggggggttatttggatgtctagttggaaaagtgaaagatcaagcctctatattcatgaagttattacacaataaattaaacagtt

SEQ ID NO: 7360 - DNA, 558 bp, Homo sapiens
tgtgtttattgcagcactgttcacaatagcaaagagttggaaccaacccaaatgcccatccatgatagactagataaagaaaatgtggcacatatacaccatggaatactatggagccataaaaatgatgagttcctgtcctttgcagggacatggatgaagctggaaactatcattcttagaaaactaacacaggaacagaaaaccaaacaccgcatgttctcactcatgagtgggagttgaacaatgagaacacatggacatagggaggggtacatcacatgctgggtcttgtcagggtttcgggggctaggggagggatagcattaggagaaatacctaatgtagatgatgggttgatgggtgcagcaaaccaccatgacacgtgtatacctatgtagcaaacctgcacgttctgcacatgtaccgcagaacttaaagtataataaaaaagtacatatagttgcaacttatctaaataataaaaaatattaaaaaacagaatatagaccttatttagtgtctatatgcaacatgccacagcagccatagcatatg

SEQ ID NO: 7361 - DNA, 1147 bp, Homo sapiens
tctgctaatatgtattctctagaaaactcaactttttttttttttttttgagatggagtttcgctcttgttgcccaggctggagtgcaatggcgcaatctcagctcaccacagcctccacctcctgggttcaagcgattctcctgcctcagcctcccaagtagctggggctacaggcatgcaccaccgtgcccggctaattctgtatttctcgtaaagacggggtttcttcatgttggtcaggctggtctcaaactcccgacctcaggtgatctgcccacctcggcctcccaaatgctggaattacaggcgtgaaccacctcgcccggcctcaacttcttttaaaaataaaatccaggttccctacttcttggtttcttttaaaatacagcaaatattatttaaaatatattaaattagtgagaacatttttgttgcttgtttcactccaaaggaagcaacttcaaccagaacactaaataatctccttaaaagaaactgtcttcctcaggaaaagatctacagacacttacttggccaactggagaagggaaaggaaacacatgcaaaatcaagaatatgccaatatcaatgtattaatctgatggaaaacaactgatactcatattttctaaatcaaaaccttaaataatgtttcactaactggaattacacatttattttttagagacagggtcgctgaggctggagtacagtagcacgatcagctcactgcagcctccacctttcaggctcaagtgatcctcttgcttcagcctcccaaagctctgggattacaagtgtgagctgcacatcagcctattgcctattttaaaaggcagttttacttatgcaataatagaaattcctaagtgctctcttatatatgcaagtcttgctaaaatgtgaaggcattataacataactaaagaaagaatacagtcaaacacaaaaacccactgattatcacagccactctgtcattgagaacaatccctcaggaatcagttctgattttaaaatggttaaggttacatcaatctacaaaactgtcctaaagacttaaactacagagaaagaactcttttgttgttttttgggaaacaccatttttttttgagatggcgtctcactccgtcacccaggct

SEQ ID NO: 7362 - DNA, 872 bp, Homo sapiens
tcattacatttaagccatctgagggctatgagcgtggcctgcaaagtcactctgagcaacacaaggtggagtttgaaagcagattcaaagccagaccactgggcttgagtcctcacatgcaagcatgtagtcttcaccatggagaagggggtttgcctttctcaaagcttttttcttttaaattaagaaaaagaactgatttatcagtctagtgtttcattttaaaaacatatgaaagggtgggtaacttgcagaagaaagtatttggagcctataattccattaagggttataatggcggtcatggttggggaggcagcattttgcatattatatcaaaatgttatggtaccataaccatccaaatgttaatggtaccaatttcttctatcctagaaacatttcattttatgttgttgaaacataacaactatatcagctagattttttttctatgctttacctgctatggaaaatttgacacattctgctttactcttttgtttataggtgaatcacagaatgtatttttatgtattctgtagttcaatagccatggctgtttacttcatttaatttatttagcataaagacattatgaaaaggcctaaacatgagcttcacttccccactaactaattagcatctgttatttcttaaccgtaatgcctaggcctaacctcaaccaaccttccacaatcttgttcacagtcagagacccaaaaaagagtgttataagtggggtgtcactattgtgaaagtagtgctaatggtgttgaattggtacctatgattcttcttttgaattagattgtatgtttcatgatctcaacttacattactaaaattcaataaactgatcatttagatga

SEQ ID NO: 7363 - DNA, 946 bp, Homo sapiens
tcattacatttaagccatctgagggctatgagcgtggcctgcaaagtcactctgagcaacacaaggtggagtttgaaagcagattcaaagccagaccactgggcttgagtcctcacatgcaagcatgtagtcttcaccatggagaagggggtttgcctttctcaaagcttttttcttttaaattaagaaaaagaactgatttatcagtctagtgtttcattttaaaaacatatgaaagggtgggtaacttgcagaagaaagtatttggagcctataattccattaagggttataatggcggtcatggttggggaggcagcattttgcatattatatcaaaatgttatggtaccataaccatccaaatgttaatggtaccaatttcttctatcctagaaacatttcattttatgttgttgaaacataacaactatatcagctagattttttttctatgctttacctgctatggaaaatttgacacattctgctttactcttttgtttataggtgaatcacagaatgtatttttatgtattctgtagttcaatagccatggctgtttacttcatttaatttatttagcataaagacattatgaaaaggcctaaacatgagcttcacttccccactaactaattagcatctgttatttcttaaccgtaatgcctaggcctaacctcaaccaaccttccacaatcttgttcacagtcagagacccaaaaaagagtgttataagtggggtgtcactaacctcaaccaaccttccacaatcttgttcacagtcagagacccaaaaaagagtgttataagtggggtgtcactattgtgaaagtagtgctaatggtgttgaattggtacctatgattcttcttttgaattagattgtatgtttcatgatctcaacttacattactaaaattcaataaactgatcatttagatga

SEQ ID NO: 7364 - DNA, 418 bp, Homo sapiens
tgccccctcgccagaagacattggttttcctgctgtcctatgtcacccggagaagagggagcaagaggctgcctttacccatcatttcttttccctgtcactacctgttagtaatgttaaagacaggtcctctggttaaaacggtttctgtagaaagaggatgatcaattttaatttcctttcccaacatgggctttgattttctgttttcaaaaacaggatacacagtgagaaatgctgggcgctccccactttgtgaccctcatctacgatgagttatgacgggttaattataactgcagggaattatgcttatatcataggagattgatattttctgtgaggaaattagaaagctgttaggaaggcccagaacatgcagaaagaaaaaaaaaacctcctttgaggcagagttaaa

SEQ ID NO: 7365 - DNA, 357 bp, Homo sapiens
tatctatgtaacaaacctgcacgttctgcacatgtaccccagaacttaaagtataataataaataataataataacttttttaaaaagaaataatgtgcaatgaatacaacacactcaggatttaagtaatctgagtatatgcatgtgttgtgttgtggttgcagttatatcattcccaatggcatattgtatatttattttaacatacaactgtttaaatcacacagctaagtattcctttccttcaccaagataactgatggcaaaataggtactcttgttacttaaacattactagcattattgccatttttacataacctctatgattttaataaagaaaattatgtaaaaaa

SEQ ID NO: 7366 - DNA, 429 bp, Homo sapiens
gaaataaaaggtagcttgtctttcattatttaagctggtagacacacctctagcgtctgaaataaacatggagaggcaaagagttcgctcatggcccaacagacagtactagaagagggtctaaaaggcccaaatttggatcacagcttggccacttaccaggtgcttgtccttggggacgtgacctaacctgtttttgcctcagtttttcgtctataaaatggggctgttgaacttaaaagttctttcctgctctggacatattattataagtgaagtactttaaagtttttctaactgctttccaaagctgctctgggctctctgaaaaaatatctttgctcaggacattttcttacatggaaatatcctcacccttctgtctctgtgaagattcagcaacctgaagtcagctcacctagtttcctc

SEQ ID NO: 7367 - DNA, 406 bp, Homo sapiens
caatatggttacattgctttgtataatttttatttttcctttgattaataacttgatttttttcttatttgtacctatccctaattcattcccaactgaattttaaacattttaaagttcagcttacacattgatttttaaaattgtgtttacacgttgattttaaaatgtaagcattagggataggtaaaaagtgaataagcaaagtgaataagcacattctgtgaataagcactgaactaatggagttaaaacatgaatcaaaatatatacagataaattagatgtaggaaaaacaatcagaaccttcagtgacattttacaatcttatcaaaaagatatgttagcatttagactatttcaggtaatatagtaaacagttgattccccgtaagcaatgtatcaa

SEQ ID NO: 7368 - DNA, 437 bp, Homo sapiens
  misc_feature (53)..(53): n is a, c, g, or t
  misc_feature (62)..(62): n is a, c, g, or t
gtggttttacttacttacggtgtgtgtgtgtcttttagtgaagaacacgatantgaagagtntgtgatactctgctttgttactgccaaagaggttaagatgagctgggataaaatgactgccatcgaggtgctgccctgaggcactagggaattaacacgtgtgtgcagcacctgacacatgccctggacttccacgtcgctgagaacctgcctctgctcagtcagcctccttggggcttccctactcataaccttcaagtgttactatgcctgaagtgtttccttccttctttcagcaaatcttcattgaggttttttaggtgctgggtagaattcacaaatgcagggacccatcccaacagtgtccttgtccccatagagcctgcatatatatgggggaagacagaagataaaaattttcaaaaatataaaaaa

SEQ ID NO: 7369 - DNA, 446 bp, Homo sapiens
tttgtcatggagtctgatgtaaaaattgatgacactttctaacttctggtgtgcttcccttccttgttcattttccataagtagcttcctccatccctcttcccaacaggccacagtcaattcaggacattttaaccatgaaaatgagtctctgtaagaggaatttagaggccaggcacggtggcccagcacttcaggaggttgaggccagcagatcacctgaggtcaggagttctggaccagactgaccaacatggtgaaaccctgtctctactaaacatacaaaattagccaggcatggtggcgggggtctgtagtcccagctgcttttcttgcccaggcataatctcagctcactgcaacctccgcctcccgggttcaagtgattctcctgcctcagccttccaagcagcgtcgacgcggccgcgaatttagtagtagtaggc

SEQ ID NO: 7370 - DNA, 267 bp, Homo sapiens
cattttaaccatgaaaatgagtctctgtaagaggaatttagaggccaggcacggtggcccagcacttcaggaggttgaggccagcagatcacctgaggtcaggagttctggaccagactgaccaacatggtgaaaccctgtctctactaaacatacaaaattagccaggcatggtggcgggggtctgtagtcccagctgcttggaaggctgaggcaggagaatcacttgaacccgggaggcggaggttgcagtgagctgagattatg

SEQ ID NO: 7371 - DNA, 598 bp, Homo sapiens
ggttatgataagagagaattaaaaacatagtccttgtcctcaaaagacatgaaacctggggccttggtaatataggaaaccttcttgccaatataggaatatgttgacatattagctatagcaaaaggcttatattagcaccgaatgaggctctgctgcatccattcacctagggaatatgcactgtggcgcttcccaaaggatcacttgcaggtacctcagtgtacctgatggcttgactgttgttgcagccattagtacatctcccttcttgccacctttctctccccaaatctcaacaaaaccagttgtttttaatcttaacactacccatcaccctcctacactcactgaaatgtcttcagcccctaacctctagaagagctgaggacatcatggaaggaaggtaagtctttctctgaaagagattgtagacctgggatataatggataaagtgatccccaagatgcacttttgatgttttaatttctcagattttttttgctagatacttactttgcattgctttgttgttgttttgtgaaagaacagacttctgattttaaaacacaaggtgaagaaatgttaaaaaaaaaa

SEQ ID NO: 7372 - DNA, 1111 bp, Homo sapiens
atagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaat

SEQ ID NO: 7373 - DNA, 316 bp, Homo sapiens
cgtgccttccaagcccattccctgttgaaaaatggcaaggtccagaccaagtttgctttgtggctcagtgttctttttcataatgaggatgccaatatgggttgtgaatggaattaaaagagttaatacactttcagcgtttttaaagcagtgtctggaacatagtgaggactaagctctgatttttttatcttgcccaaattcctgtctaaggggtctgggagtcatgccctacaaaccataaaatcccatcagatgggttttatttgacactgtatatcgtgacttaccttccagtctgactctggcataacat

SEQ ID NO: 7374 - DNA, 523 bp, Homo sapiens
ctgccaccctcccgttggcctcaggagctccatgccccattaatcctgtctcccatcaggagctccatgccccattaatcctatctcccatgtgaatgcccagccttcccctgtacccaggagcagagacagcacccagaccagctgctctaaccttgccaaagcccccagtacaaaaaggtaaacaggaaattcatgccggggtggaagcttattaagaatcgggtttcggccggtcatggtggctcacgcctgtaatcccagccctttgggaggccaaggcaggaggatatcgcatgagcccaggaatttgagaccagcctgggcaacacagagagactccatctctacaaaaagtttaaaaaattaaccagacgtgatggcacgtgcctgtagttccaactatttaagaggctgggatgggaggatcacttgagctaagggtttgagactgcagtgaaccgtggtcatgccactgcactccagcctgggccacagagcaagatctcatctcaaaaaaaaa

SEQ ID NO: 7375 - DNA, 234 bp, Homo sapiens
tctaaagttttttcttgccctgcatgttaaaaagaatccaaaaaacaggacaactcatcccatattttcattattacactgtgtcatttctttgggtttgttgaagaagtttttaagaggaatttattgttgtttttcagtatttacattacattactttgggatagagatccccaattacaaaatccaccagtagatggaactttaataaaatatataaatgtgtgtatatct

SEQ ID NO: 7376 - DNA, 335 bp, Homo sapiens
ggggtgcacagctctgtttgccttcatcattgtaacccgtagaaagaaaacttgagtaaggtcaaggtttccatgctttccttaaagtgtggagccttttattccatgaaaaggttatacaaaaatccaggttatcaagcaaataaacaagcagttcttactcagataaacaagatacaccccctcaccctacctgctcaatttctctttctccactcccccaaacccacctccattgtagttcctgcagggggtcccgtaagcttattttgaaaatcactaggatgggctgggcgcggtggctcacgcatgtaatgccagcactttgggaggcc

SEQ ID NO: 7377 - DNA, 228 bp, Homo sapiens
gcaggtgataagattagggcaagaaagctgcgatttaacagtttccaggcacttgatatctcaccagagctcagctaccagttgtctgcattaatccccaaggcaaacctgagaggcaggtgggtggaattgagctaccttttatctcagaaaagggaaaagccaaaccccttgaacatcagtttctggagggcaagagggctctttccccagcgtgcacctcaccac

SEQ ID NO: 7378 - DNA, 395 bp, Homo sapiens
gggaggctgccctctgggttccagtcatatctcaattaaagaataacacacgcccttcccctaactcatctagaacaaccccatgtacgtagctggcagtgaacacaaaagctctctgagtagccggaagagcccacaatttcatcagctctctagacctgttggacaccctcagatcagggtgactgagggagtgtgggcaggaagcccagaccaggaatccaggagaggctgcttagggctttggggtccaggcagagcaggaactataaggaggtggagccacttggaggaaggcgaggaccagaatggagtggagtggctcttttggctccacatgaccaccatttagctacttggtgtgttggcctctctacatccagttgctgcttctc

SEQ ID NO: 7379 - DNA, 367 bp, Homo sapiens
aatgagctgactttcttttctggattactcttttatgtaataaaaagtagacatgagggtcaaacagaaagggaaaaaggggaatttgtttaatttctaccaagtgccaggcatagtacaaagaacatttagataaggcagaaggcattaattatttttatctacccagaaccccctgccccacctaagcaccccagcccctgacctggccacgtgggtggctatgtgacccgagctgaaccaatcagagtccttccctgggatctttttcacatcataaccacatgagaaggtctcccattatgaaacagagaagcttgttggcagccatggttctagccaaggatggaaaaaacaaccaaaaaaa

SEQ ID NO: 7380 - DNA, 366 bp, Homo sapiens
ccaatctctaatcattcttcaggtcctcttatatccctaaaaactgggttaggtaacccttcctcgtgcagcagtagaaccctgtacttaatactgacacacactatcttaaccaaaattgcctattctttatgccctatctttacttctagctgaggacaccttgaactgtgttttgcaaaccattggtgttgcatcacctattgcaattttcctggtatataataaacacaaaatttttttgagttgaattaatatattaaaacaatgtttgatggcattataaatggcaatgtatctgattattttttccccgtaggaaaaagtgtaaatttccttcagctcaataaagctagttaatgttct

SEQ ID NO: 7381 - DNA, 303 bp, Homo sapiens
cgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttatttttaagtcagtcttcgaattattacaccgtg

SEQ ID NO: 7382 - DNA, 413 bp, Homo sapiens
cgatcaaagaaatccaatgattaacagatttaggattcactattatatagaataaaaatcttttaattataaatgcatatatatctatgtgtgtgtgtgtgtgtgtttaaagaacttagattcaacttcccctccaccaccacttaaagtatgaggagctaggagcaatacagtgttgacagtccctatcctggcagggggcagttgggaaaacactggattagaaaagatgaaagacaatggagcttccctaggagactgatttttgaagggcttttgatcatcctccacccagtgtcaaagccagtcatgaatcctcagaaccaaggaggtcctggcaagttctgttgtggttacccgtcggacatccctgtctggtcaccggggctccgaggggtgccctgctctcagga

SEQ ID NO: 7383 - DNA, 452 bp, Homo sapiens
gctatttttcaaattagccatttttttaacagcagaatgtgctaaccaattgcaccacagacacatgtagccattttttattttttatgttgataaatacaaatgcctaaatgcagaaaattagccagtgaaatttttaaaacatcaacaactttaactactatagatgtttaaattcacacttaaaaaaactgtttcagtacatttgttgaacttagaagatacatcattttattaatgattacagattttttttactacaccattatctttatttggttaataagttatctcgaatttgcaggtggattggtccatgaatagaaaattaatatctcggctaggcgtggtgcctcacagctgtaatcctagcacaggccaaagtgggaggattgcttgaggccaggagttcaagaccagcctggtcaagatagtaagaccctatttctaaa

SEQ ID NO: 7384 - DNA, 363 bp, Homo sapiens
accaaaaaataggaaaaattagccaggcatgatggcacacagctgtagtcccagctcctcgggaggctgaggtgggaggatcacttaagcccaggaggcagaggttacagtgagccaagatcacaccactgcactccagcctgggtgacagagcgagatgccatctcaacaccatcttaaaacaaacaagacaaggtgactccaggtgcaccaggtcctgcaggcatcacacctgcactgctcttcagggaaattcacggaacaaatgcgccatcgtcacgagaactgattgcatcgatgggtatggccatggtgacaagtgaccgacagcccagcagcctgcacgcagaggtgtcactgtag

SEQ ID NO: 7385 - DNA, 186 bp, Homo sapiens
cgtcctgtgcctcacccgggcccagcagccacgggcacacacttggcaaatgcaccggctcgagggacggacgggggtgtgggctgtgcctcgttggtgtctcgaggggagcagctctgacaggcgggagacacggccacgcggtgctgcctgtcagagcatgttctgggagctgctcattgttcc

SEQ ID NO: 7386 - DNA, 230 bp, Homo sapiens
ctatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacacacacacacacactctctctctctctctctctctctctctctctctctctctctctctctcaaaa

SEQ ID NO: 7387 - DNA, 340 bp, Homo sapiens
tccgcctcccgggttcacaccattctcctgcctcagcctccctagtatctgggactacaggcacccgccaccgcacctggctaattttttgtattattagcagagacggggtttcaccatgttagccaggatggtctcgatctcctgacctcgtgatcaacttgccttggcctcccaaagtgctggcattacaggcgtgagccactgcgcccagcccccaatcaccttttcaataaagctttctaaaaatatatcctggctgatatcattgtatcaagctataaaatggggacctttctttaacagtttctttgtagatgaaaatttatattgagagatt

SEQ ID NO: 7388 - DNA, 315 bp, Homo sapiens
ggcaagtggtcattgtccacagctgtgtatcaggacaccatggttgggaactcttgccagggaatagctcatccatattttagacacttctgatcatttattttaggtatataatagtttcccggcatcatcaaagaaaaaacgtatttaaaaatgaactcaccccaaccttacactttcagtttttcgatttatgtctcttctttgtaactcattattctgaatgctttcttgctggaagagtaaaggcaattattctcctagaaatgttttttcctaaaaattatatcattatatatatcaatgaaaactgtt

SEQ ID NO: 7389 - DNA, 449 bp, Homo sapiens
acaaattcgtaaccctgaattgtagtccatttcccattaccaagtgtttagagtgccctagtggcaactgtaagtcaccttttatagtgaggtgttactagctcacttttaaataaaattggaacagcttggcttttgtcaatgtagcaaaagatgattttttaaaaggtgggggtggggcacagtggtacacacctgtaatctcagtactttgaggctgagatgagaagatcacttgagaccaggagttcaaggtcagcctgggcagtatagtgagacctcatctctacaaaaaaattgtaaaattagctgggcgtagtggcacacacctgtagtcctagctactcaggaggctgaggcaagaggatcacttgagccgaggagttcaaggctgcagtacgctgtgtgcactccagcctgggcaatggagcaagaccctgtctcttaaa

SEQ ID NO: 7390 - DNA, 349 bp, Homo sapiens
tagaagactttgggagatgtcaaaagtagactcactatttcattatcaaaatgcagagagtggggctggatgcagtggctcattcctgtaatctcagcactttgggaggctgaggcgggtggatcacctgaggtcagaagttcacgaccagcctgaccaacatggtaaaaccctgtctctactaaaaataaaaaaaattagctgggcatggtggcaggcacctgtaatcccagctacttgggaggctgaggcaggagaaacacttgaacccgggaggcgaggttacagtgagccaagatcatgccattgcattccatcctgggagacaagagtgaaactccatctcaaa

SEQ ID NO: 7391 - DNA, 488 bp, Homo sapiens
cgttttaaatgtaccacatggcagacatgcactggaaagtcatgtgtctgcatgtcctgacacggataaaggcatatagtcaggtgggtgatagactatcctgaaagattttttggtcaggaatgattggtcagagacagcaatatacccatataacaaatctgcacatgtaccttctgtatctaaaataaaagttgaattgcaaaaaaagaaatggccacagccacccaatcttcaacagccaccaccctgttcagttagcagccatcaacatcaaagcaagaccctccaccagcaaaaagattacaacttgctgaaggcccagatgatcattagcatttttttaccaacaaaatatttttaaattaaaaaaaaaatgacaatatgacattaactggaagaaaattgaaagtcttgtgcttaaatttaaaaaatccaaaacccagaaatgctagccgtgggagattggccttatagcaatttatgaa

SEQ ID NO: 7392 - DNA, 218 bp, Homo sapiens
taaatatcagttttaaagttgtttcttttataaaaccttatttcccaggtcttatggttggaaaaagcttgtttggcccaacactggtaaacctgatgactataagaacaaaaaacctttaagcgagcaaataaataaattttcttctcacaatacaaacttctcgactatgattctaccatagcctgcttaattcagagcatcctgtttgtttgttt

SEQ ID NO: 7393 - DNA, 217 bp, Homo sapiens
tctgacagctttatcagggctttaaggaaacgctgaattttgtccttagccaattgaaatgaagacacatgtttgggtcagaaaattggtcaaattatgaacacgtttagtcacaggaagagtttagacatcagagcccgatgaagtggaagttatttgagaaatagtggttaggtttataatgtgatcaacacaaaatgatgcagtttagttattt

SEQ ID NO: 7394 - DNA, 391 bp, Homo sapiens
cttaaaaaaaaaaaaaagacatttgcactctttttaaaaataaatttcatagtatgattgaactataaatatgaaatttaaagtaaagaaaggaaacttattcataagttctggtcaccaattttaagtaaagagagtaaatacggtcattcagatgttaacaatattatagaaaagaatggaaaacctggattatgtttctgaaatatataagcttagaagaagaaagaagacagtggaatctcagatgacttcataatgccactctgtaatgttatcttttagtggcagttacagttctagtccttttatatatactagtacactcagaaatcaaagaactgggtggtagatgggaatgtctgcattgccctgggattccctattggtg

SEQ ID NO: 7395 - DNA, 501 bp, Homo sapiens
ctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggctaagtgacttgtccaaggtcacacagcaaatgagcaacaagtcttcgttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaa

SEQ ID NO: 7396 - DNA, 212 bp, Homo sapiens
ggctaatttttttgtatttttagtagagacagggtttcactgtgttagccaggatggtcttgatctgacctcaggtgatccacccgcctcggcctcccaaagtgctgggattataggtgtgagccaccgtgcccagtctgttttcttttatgtatttttgtttctgacaagagtatgctgcttgtggtgaagaaaaaacaaaccaaaaaacc

SEQ ID NO: 7397 - DNA, 386 bp, Homo sapiens
tcaatgagcaccgcattggacaaggtctaagcacctgcggccttccctaagcctggcaggcccatggagagagggaaggcgagaagagcaaaacagtggccaccaaagcaaggtgaatccccagctggggaagccaggcactgggaggaggaagtcataaaaatagcaaacacaagttagaaggtttaaagggaagacgttaggaaccactacagagaggtctggaaagagaagtggcttacaaaaaaaaaagtttgaaaagttagaaggccatgatggaggggtttggaagttgccacaaggttgggttgatgagagaattctaaactgatgtgtacaggatacacaagcatttgatggtacataaataacctcctttaatcgtc

SEQ ID NO: 7398 - DNA, 2031 bp, Homo sapiens
gaaaagagaggaaagctaaataaccaagtaaatctgtatctaattaacaaattggctaaataaggtgttatcagctgcttgatatagagctgataaaatcttcagctaggcatacttgaggcctgattacagaagtgaccgtagtccacccacacacctgaaatttatttaagagaccaagctaggctcttcctggcctttaggaagaggactggcatggagaaatatgttcctcactagttctcccaagccatggcacgtcccaacaaattcctcctttggttttgctgctttgcctggctgtgttttcctattagccttggttctcaggcttctgggggagaagctcagattgctgctagtgctgagttggaatctggggctatgccttggtccttgctgcagcatatagatgagagagacagagctggcctccttcccgcgcttttcaaagttctatctgttgggcgaggtgggtcacctaggctgcagccagactccagagctttgcactacatgaagaagctctataagacatatgctaccaaggaagggattcctaaatccaatagaagtcacctctacaacactgttcggctcttcaccccctgtacccggcacaagcaggctcctggagaccaggtaacaggaatccttccatcagtggaactgctatttaacctggatcgcattactaccgttgaacacttactcaagtcagtcttgctgtacaatatcaacaactcagtttctttttcctctgctgtcaaatgtgtgtgcaatctaatgataaaggagccaaagtcttctagcaggactctcggcagagctccatactcatttacctttaactcacagtttgaatttggaaagaaacacaaatggattcagattgatgtgaccagcctccttcaacctttagtggcctccaacaagagaagtattcacatgtctataaattttacttgcatgaaagaccagctggagcatccttcagcacagaatggtttgtttaacatgactctggtgtccccctcactgatcttatatttgaatgacacaagtgctcaggcttatcacagctggtattcccttcactataaaaggaggccttcccagggtcctgaccaggagagaagtctgtctgcctatcctgtgggagaagaggctgctgaggatgggagatcttcccatcaccgtcaccgcagaggtcaggaaactgtcagttctgaattgaagaagcccttgggcccagcttccttcaatctgagtgaatacttcagacaatttcttcttccccaaaatgagtgtgagctccatgactttagacttagctttagtcagctgaagtgggacaactggattgtggctccgcacaggtacaaccctcgatactgtaaaggggactgtccaagggcagttggacatcggtatggctctccagttcacaccatggtacagaacatcatctatgagaagctggactcctcagtgccaagaccgtcatgtgtacctgccaaatacagccccttgagtgttttgaccattgagcccgatggctcaattgcctataaagagtacgaagatatgatagctacaaagtgcacctgtcgttaacaaatggtcctcttaaaaccttgagcctatttggcaaagtaactactgtgtgcctatgtgtgccttcaagagaaagcttcatatattaagtctctaaatgtagcatatgttatataaagaggagcctgtgtaggttagtaccttctatggcatctatcaggataaagggataacatcaattgttgctacagagcctttttttatttccaaatttaaatgaaatataattattgtggagaactttacatttttttccttgagtgattttttttcttttcataggagtcttattcttgatagggaaaaaaccttaattagcatcaatcctggatggacttgcagctataaataggcaattcagattgctgtagtcttaatagaagaataaatttctgtcaatggcataaattttgt

SEQ ID NO: 7399 - DNA, 1220 bp, Homo sapiens
gatttttctctcattttattgcatccttggcttttgtcctcaaggttgcctcgtggcacaaaataattgccagagctccagccttcacctcctcattctgagggaaagtcagaggccagcgctggctaggtgtctcctggaagtcttcccaggaagcctcgaaacccttctttttatatcccactggccagaacagagcgaaatggccataccttgctgcaggggaggctgggaaatgtggctgtccagatggatgagattctgttacaggcataaggggagcggggggcttaggcagtgattctctaagtgtctccatccatttcacagatgaggaaacggaggccccaagagaggcagtgactcaccagggggcccacggccaggactgaggcaccagagccaggattctcacctgaaccccataatctccatgctgctgatgtgcaagtctcagactctgcaaaatccactgcaccccctcgggctgtgaacatttcaaatccatgtgtgcccaagcttggagcagcccagggccaggggcacggctggagagctggacccaggttcctggctgtggacccatggctgagggcttagctgctttgtgcctcagtttcctcatctgtaatatggggacacgaagtggccctgtctccaagggctctgacaagacacatgacttcatgtgaggcattccggggacccccacacaataggtcctcaatgtgtgttaatcgttctcatgctgctgctgcttttggggtgtaggcatgggtagtttctggggctcaaggaaataacagaggggtctccaaaggtctcctgtcttgcacaacccacaagtaaactctgatattcactaaaaaaaaaaaaacaaaaacgaagaaacaaaaaaaaaaaaaaaggggggggcccccccaaaaatttccccacggcgggggggccaacgtttatcgcgttcacccaagttttcttggggtaccaaagggggtgcgccctatagtgaggaggccggaattaataaggctcaggcgctggggcgcgtctgtttaccaacagtctgtggatctcgggaacacttggcatcgttgggggatccttgtgggagagggaacccattcatctcctgggggggggagacctcttggcgcacatctcacaacgggagatttacaacggcctacggggagtattacacctgacagcgatcacgtggc

SEQ ID NO: 7400 - DNA, 263 bp, Homo sapiens
aagttctgaagtccttgaccatcgaaggattttacctagatctctgacgacctaccttggcttttctttaccggagaattgcccatctatggttctttgctccatctgtgcaatttgcccttttcaggacttgaggacaacatggtcgcctttgccttgcttggctgtggtttggggtggcattaacaccatgatttctttcagggcccactgaaggttggtttctgcgctcctgcgccacctgctgtcaccagctccaagtg

SEQ ID NO: 7401 - DNA, 216 bp, Homo sapiens
aatattctttatcttattaaacgtaacatagaatatgatttcaaaacacagtaatgataatttttttctaaagctaagtatttctcaattgttgtcagcaaaaaggcagctcttagagcttaaatgttaattataactatataacattgcaaaaggagattttgagatctttagtcatcttcctcttttctgtgtgtgaatccttaatctgaactt

SEQ ID NO: 7402 - DNA, 451 bp, Homo sapiens
tagtaggtggtgttttaaagggaaaaccaacacatagtgtttgtcacggtactgttgcagtaggtttttaagaattatcatcatatgatcgtcaccaccatccaaagaggtagttcctactctattaccattacagatgagaaaactgagggacagtgatgataagttagatttgaacccaggaaatttggccctagggtatatgctctttaatcactgcacaataatacctttatattagggtcttaggtaatatctttcttcttctctagcttgagaaatttttttcctacaattataatgagtgaagggttttttttttaaactagtttttccacacaccaaagctcatcttttcacttctttaataagtgggcttttggctttacttttctatgacagtaagttagacagcaacttttagccacccccacacaatgatgtattttaa

SEQ ID NO: 7403 - DNA, 297 bp, Homo sapiens
gtgccattgtaaatcgtgtgagcaatggttgggtgtgcaggcttgaagtcagaaagttttgggtttgagcctcaactctgccacctccttgctgggttatcttaggcaagctattcaacccccctacacctgcatttttaaaatctgtgaaataggaataataattgtggctgtctcatataagcgtttgggagaattaagtgagatgacacttataaaatcctggcacataacaaatgataacaattggttaaataaaattatttatgttttaaaaaaagcatccttgggaaagac

SEQ ID NO: 7404 - DNA, 378 bp, Homo sapiens
cattaatcctcctttctactgactttgaaatggaaaattaaatttcagaaaccttttgattgcacacatgcatcccacaatgtttcatacaccaatacatatataggtagtttgaattctgtgcaccaagccacttgcactgacactgatactaatgtactgtgagagagcagcatactttaaacacttgccgatgtgaatcagacttgagagaacttgagcgtgcgtaagcaccttgatgtcttatccatttggaagcttattgttacagtgcgttttcttttctttctttctttttttttttttttgagacaaaatttctctcttgttgcccaggctggagtgcaatggtgatgtctcagctcactgcaacctcca

SEQ ID NO: 7405 - DNA, 428 bp, Homo sapiens
agaggggtactagagcatttctagggatttcatttcatggtttatctgagtaaatactgtacctaattcctcatccctgaatggatcttctacaatgcttattcatattaccccttccctactttcactgcttttgcctttaaaataaagactggacaggaaaccagtaattttccttaagtagaggattaatatggtagtgtccaaaagcaatcaattccttgagacggagtttcactcttgtcaccccggctggagtgcgatggcacaatctcggctcactgcaacctccacctcctgggttcaagcgattctcctctcttaatctctctagtagctgggattacaggtgcccaccaccacgctggtctaatttttgtgtttttattcgagaccagcctggcaatatagcaagacttgttctctta

SEQ ID NO: 7406 - DNA, 415 bp, Homo sapiens
ccatgattgcccttctgcactccagcctgggcagcagagtgagaccctgtctcaaaaaacaaacaaaaaccaaacttttatgatctaagccttctttgtaaatattcttagattttaaaaattgatttaatggtataattcattcaataggtatttattgagtgccagctatgtgccagccactgtttaagattctgcagatgcatcagggaacaacagaggaaatgtaaccaacattgactttgtcagcacagcacactacttatttgatgattaaaaaaaaaaaaaaggccaggcacattggctcatgcctgttatcccaccactttgggaggcagaggcaggaggattgattgaggccaggagttcaaaaccagcctgagcaacatagcaagaactcatctctacaaaatta

SEQ ID NO: 7407 - DNA, 404 bp, Homo sapiens
gcctactactactaaattaaaggcgcgtcgacggcaggagaatcgcttgaacccgggacgtggaggttgcagtgagccgagattgcaccgtagcactcctgcctcagcctcccgagtagcttggtctacaggcgcatgccaccacacccagctaatttttgtgtttttagtagagacggggtttcacaatgttggccaggatggtctcaatctcttgaccttgtgatccgcccgcttcagcctcccaaagtgctgggagccaccggcgcctggctggaatttgatttttaattgacattcaattttattcaaaggcctttggcattttttggatattatcatgttattttctaagttgtgataattatattgtactacttttgcagagtcatggcatctatttt

SEQ ID NO: 7408 - DNA, 607 bp, Homo sapiens
gttcccatcaaatgttaatctgcttgtcctttccaacaatcaatgcatttgctaaaagctatgaaattctcacttggagaagggatgtctagagaatgaaagcatgtttggaaaagagaagcaggtggagaggtaggggttctcatgaatttcctgatgcattaggatcctatttttaaggtcctcaccacaagatcccaaaaggtcaaacgctgaatcttgctctagggaaaatgtggccaggagtagccccctctttagcaaaccaagagcccgggccagtcattgcctgacatttccaagtgaagtgggagaaccctgatgccctgagctgcaggcaaggcacagagctgtcaggtctcaggcatcgtccaggcagctgacatggcctgctccctcgttcctgcccacgtgtgctgtgagtgaagctggagtccagccacttaggatgtgtcacaactctggcctctaaggtcctagaggaaggtgtccagccatgtctgagtttgtgcaaaacacacggcagaccaacagctcttctttcagcttaatggactgtttccttcttccacacctaaatttatgtgtatgatttagggactgtgac

SEQ ID NO: 7409 - DNA, 1061 bp, Homo sapiens
ctcaatggagtttagagaatgggacaaggagtctttaggcgtagcacccagatgcctgtaattgattagagaatgtgtatataccatttgtggcaaagcagatataaaacaggcatggacgcatgattttaggtcaaggtatttaattatttttacttaaaataggcatttttggttgggaaagagaaggatgaacaatttgatgtcacctttaagactgatgtttttaattctgcttttgggaccacttgatctagaatgccttgaaaattccagaaagatttaacaacacactgaggtaagcaaaacaagaaaagaaagtaggggtgaggtgatacccagataatgcaaatgcaggatgtattgtctgtgaatttcagcatcaatctgaaaaacatgttttgataatgcctgataattcatcatctcactgattacatgtctttttttctatttgtttataatcttgtgtcttcaaatgtgtggaagatgtgccagacttatttttaggtatctgagataggaagggccaatgttggcataatttgaacccacatttcggggctaatgggcggacaccacctggaaacacttacctgcaccctctgttttgcaatcacaatgattagcatcttgctgaatgatgaccccaatgtgaagatggcatttcagtgtttatttctggatctatgagttactttagcagagttattagtagtttataaagccatatttaaacttgtacacttgattgtaagatagatttgaattgtgcactatgttgactactgtatataaatgtggaaattctgtatatttggtcttaatgctatatgtatttgatgtgtaaatgataactaatggatatgaaatagttttctgtgaatgtctttcttccaatttacttctcttttgcaaatttgaatgtttaaacttcaggctcatggggaaaatctgaaatgtttgcatctaatatactgttaagtggtggtctcttagatgactgggagagtattttagttgtaaggctcttgtataattaaaacagaggtaatgaaaaa

SEQ ID NO: 7410 - DNA, 474 bp, Homo sapiens
ttatgaaacacatttgatttaccaacttttagacttctgttttctacaaattagctctcttgcgcaagtggagaaatagcatatgtatttggtactaagtttccctcataattgtcagaacctcaccatttattgttttgtagaaactgggctttaaaaaaaatcagaccatatggtaattttgatattaatactcttttgaaagactaagtgaatgaactagtcatctatattcactgattaaaaacaaaataagacaaacttattccatagtatagtactttgggtttgtctaaaaaaaaattcatttacaaatactatttctgagggacaatagcatttctctaggatacatctatgtacatgcaactgaagaaaatagcttttaaatttactttatctcttgtagtagttttatagctacataagagtattgtaatgcaaaaggtacatcataaaaactgctttgttata

SEQ ID NO: 7411 - DNA, 399 bp, Homo sapiens
atttttttgagatgtagtttctctctttttgcccaggctggagtgcggtgttgcagtgagctgagatcacaccactgcactccatcaaagattagtctttctcctgggaaaaacaatccgagtaagaaggtcattcaagattagcatggaatgggttctatagaaacattggctgataagaaagcaataaggggtattgggaaaagccccatgcttacagttagataatctgggtttaaattttgcctttatgcttctagttttatagatcttgggaaattacccaaccaccctaagtctcagcttcctcatctgtaaaactggcataataatacatggcttattaggaagatgatggatgtgaaagtgcctggaacatagtataataagctcaaacct

SEQ ID NO: 7412 - DNA, 484 bp, Homo sapiens
tgctaggattacaggtgtgagccactgcacccagccaacatgttcatgccttagagcctttactcatgcttccttctacctggaaagcccttctcccccctactccatcattcctcacgcctaaactaacacttccttggtgaagccttcccagaccatacaattgacagtggtctggctggacgtggtagttcacatatattatcccaacattttgcgaggccgaggtaggatgatcacttgagcccaagagtttgagaccagcctaggcaacatggtgaaaccccttatctacaaaaaatgcaaaaattagtcaggtgtggtggttcactcctgtggtcccagctacttgggaggctgaggtaggaggatcacttgagcccaggagggccttgagggtgaggctgccgttaagccctgatcacgccactgcactccagcctgggcaacagagcaagaccctgtctcaaaagaaataataata

SEQ ID NO: 7413 - DNA, 627 bp, Homo sapiens
gcaaaaagcaatgtagtgcacatactttgtacctttgtctttgaagtagttacatgagcacctctagcattgatttctagatgcgaaattatttggtcaaagtgtggcagattgcctttaaaaatgcctggtcaggctgagcgccgtggcttatgcctgtaatcccagcactttgggaggctgaggtgggcggatcacgaggtcaggagttcgagaccctcctggccaatgtgatgaaaccctgtctctactaaaaatacaaaaaattagctaggtgtggtggcgtgcacctgtagtctcagctacttgggaggctgaggcaggagaatcgcttgaactcgtgaggtggaggttgcagtgagccaagatcgtgccactacactccagcctggtgacagagcgagactctgtcaaaaaaaaaaaaaaaaaaaagcctggtcagtacttacacacattaacaatacttgttatttacaaataccatctcccatatgagtagccaggattcaaatttagagactctgcctctagagcctgtatgtttaacctttttatttcatctgccttagtgtccccattagaaaaagaggataatagtatctacctgtgtactagttaacctattac

SEQ ID NO: 7414 - DNA, 524 bp, Homo sapiens
gattctttaaagcagaaagtagtggctaaaatggagtagccaattacctggttgaatatagaaagtatattcaaacatcctcacagggtcccctggcagagacttggagatttacctgctctagacacttaaggaaataactgtccaattaactgaacactgaggtagctgggtacagactttagcggctacatttgacaaacattgcaattacaagcagcaacacaaaccaaccttgggatggggatagaattcttttctttcttctttctttttttttttttttttttgagacagagtctcgctctgtcacccaggccggagtgcagtggcgcaatctccgctcactgcaaactccacctcctgggttcaagtgatcctcctgcctcagcctcccaagtagcttggattatgggtgcccaccaccatgcctggctaatttttgtatgtttgatagaaacggtgtttcaccctgttgaccaggctggccttgagctcctgacttcaggtgatccacctgcctc

SEQ ID NO: 7415 - DNA, 842 bp, Homo sapiens
gtagttcagaagtcaaattgtgtagctttactattgccctttctaaaggggctcaaacctacatatgaaagcaaatcccaatatgtaagcctttgtgtggttaacatttctgtctactctctcaatagtatggatttaagtgatatttttcatggtgcctggaatgagatgtagtgattcactgtcattgtttcacagaactaagatggcataaatgctgtgctgatcctatttttagttgccttcacctgtcctcccatcatgtaacaagtctacataagaacattttaaatatgtgcatctgtttgtgttcctagtttgtacaagtggaatgacagagtggagtaccagttagagtgcaaacaacctgctactttcattcctaataacgtcatacttactaaacactagttccactctctatgcatgtcccaccattgccacatttcattaaactgcagggagaagcatgacactggccaacactgcgtccagcatttgggtggccctcaggatttcccagtcctctgaaatggccatccttctcagtgcgaacttgaagagtgaaaatacagccttgaagaaatgcaaaaacacttcgtgttaacaaacagaagaaatagaaaaaacaagaagaagagattttgcctttctatacatctttagaaagaacttctcggccgggaacggtggctcatgcctgtaatcccagcactttgggaggccgaggcgggtggatcacgaggtcaggagattgagaccatcctggctaacatggtgaaaccccatctctattaaaaatacaattagccgggcgtggtggcgggtgcctgtagtcccag

SEQ ID NO: 7416 - DNA, 1009 bp, Homo sapiens
gtagttcagaagtcaaattgtgtagctttactattgccctttctaaaggggctcaaacctacatatgaaagcaaatcccaatatgtaagcctttgtgtggttaacatttctgtctactctctcaatagtatggatttaagtgatatttttcatggtgcctggaatgagatgtagtgattcactgtcattgtttcacagaactaagatggcataaatgctgtgctgatcctatttttagttgccttcacctgtcctcccatcatgtaacaagtctacataagaacattttaaatatgtgcatctgtttgtgttcctagtttgtacaagtggaatgacagagtggagtaccagttagagtgcaaacaacctgctactttcattcctaataacgtcatacttactaaacactagttccactctctatgcatgtcccaccattgccacatttcattaaactgcagggagaagcatgacactggccaacactgcgtccagcatttgggtggccctcaggatttcccagtcctctgaaatggccatccttctcagtgcgaacttgaagagtgaaaatacagccttgaagaaatgcaaaaacacttcgtgttaacaaacagaagaaatagaaaaaacaagaagaaggttatttttcatttttaaagtagaagtttttcaaaataaagtaatacatgtaaattttaaaagaaatataagaatacagaaatgcgcagagaaatttttttttaaaagtcattcatgatatcatttcacagcagacaactattaacattttggtgtgtgtgtgtgtgtggtattttttctatgcttagtcatattttcttttaaacaaaaatgcaatctgcactaagctgtagaaaatataatattataccaaaaagttgaacatcataaataacattaacttttttcttgtagcattaactatttttaagtgatggcatattttcttatatcaaaatatatttaataaacctataattattataccatt

SEQ ID NO: 7417 - DNA, 209 bp, Homo sapiens
acagcatctgtaaaaatagggtgcttctgttgcccagttgtctggtggcattgactttgctcataggactttcatgtttacagattcagctgactaacatgggtgaggctgttgcaattcatttagcagtaagtgggtcatttagtaataagctgtgaatgaaatcagtgtgctataagatgagataggttggcttgttttcttttatt

SEQ ID NO: 7418 - DNA, 313 bp, Homo sapiens
tgggaaaggaaagagcctctccatagagaatccccagttctgccaagcgtttttaatgcggttcaatctcctggccatgtatgtttcgacaattagcatgcacacatttgaaaaacacacagtgtcttttccattttcttccttctcttatggagaatgcatccaagagcctatgaagcaactgttgctgatctcaaatcccaaaggacccaccattcactctcaacttttttcataatgcatttcattatagcgtaaccctgacccagttctcctgaaccataaagacaggccacttctttctcatcatgct

SEQ ID NO: 7419 - DNA, 731 bp, Homo sapiens
cctcccaggttcaagagattttcctgcctcagcctcccgagtagctgggactacaggtgcatgccaccaagcccagctaattttttgtatttttagtagagacggtgtttcaccacattagccaggattgtctccatctcctgacctcatgatctgcctgtctcagccttccaaagtgctgggattacagacaacatgttttaattattaatttcagaagttagatggatcaagatttgagccaaggctcagaggatggctggagatgagagatggaaggatgctcagagggtgttcaggccaaggagaagcagatggaaccacagagcaggtgttgcgaggggatggggacaaccttagaagatctgcttgttggaagccagagactacgtcaggagtcaagggaaagaggaatcgatggacagatcgggtggcactttgggtagaagctggagcatcagacaggctggacttgatgcaacagttggcagaggagccactgcagcctcctaggcaggtgacgacttaagaagagcaattccgtgggctgcctcagtctctgagcacaggatgacctgaagacacatggacctaggaggaggaaggtgaggggccctgaccgtgatgggatctggaggaaggagctccagagtggggatgcctccagagttgaagatctaggaagacttcctgtccacttgggtatgaagggaaaggctgggagaagggag

SEQ ID NO: 7420 - DNA, 405 bp, Homo sapiens
gatgtgagtgattaacatttgaaacactgataagggaatacatagtgtaagggtagttgtttggcattggaaataccctaatgaggagataactactgtaaatttaacctgcttatctttaaatctacaccagagagttttctagttagcataaaggatgtcagaaataatttcaaattggattgattagaaataccatacaggttcctctggcacatgaattgctcataagattctggcaagccaggtagcctaatgcctgcacagtgtcacccgaggcagagcactgttcgggcctgttgactatcacctaacagaagatgcttcctacctggtagaaaggtagtgaggagacctatggccatgcctgtcttcagtctttggaggcactgatatataccctcc

SEQ ID NO: 7421 - DNA, 597 bp, Homo sapiens
ggaagaagaattgtcttgggccacatataaaacacactaacattaacaacagctgatgagctaaattaaaaacaaaaatcacataatgttttaagaaagtttactaatttgtgttgggcttcattcaaagccatcttgggccacatgcacgttggacaagcttggtttaaaggatcactctgactttggtcatgggtagggacaatgcagggagaccacataagagtccaccataataatatcaagagccaagatgaggacactgtcctgcacccctccctccatagcctatgagagctccctgaaacctattatctgtgcatgttctgcaaaatcgcctgccccaaacaattccatttcctgacctcctcttacactgcccaaactgggaaaacaaggtcaaaaataaatgacagtggttcagcttcaggcccacaggaagtgaataactcatttacatttaagaggggactgactgagaagcccctatgaatttaaataaaaggagtagtgactggggctagaagacatagggaggacagcggcagaagctctgggaaagtcatcaccctttctcttctccctttgcaaggttga

SEQ ID NO: 7422 - DNA, 340 bp, Homo sapiens
cacttcttggaccacatattcttgactatttgcaatactgacagaaaaatcttgatcttcccctcaaatctgtccctccgtaagcttttgccatcttaataaattgcgaagtggtttcaccaataaccaatcccaagagaggacttccactctgtggaggacagaagagatcatcatcactgtgtcaaccacaaggaacaggagtctgaacacttctgtccactgcgtcctcagctgcagtgttaccaattccctgagtctatgagacagaacacactcatatgcaacacgttacatgaagcaagttaattacttacagataggcagcaagaaacaaaac

SEQ ID NO: 7423 - DNA, 471 bp, Homo sapiens
aatcatttccctttcttggatttgaactgttaagttttgggaatttagggatgagtaaaacgcatactcccttcaataatctcatattctccatccctaagactttaaaaatgttaaagcaaagagatttctctcccctccagttggagatggagatgagacataacagagaaattgctgttttaaaaagagaaaaaccggccagatgctgtggctcacgcctggtaatcccagcactttgggaggctgactcaggcggatcacctgaagtcatgagttcaagaccggcctggccaacatggtgaaataccatctctacaaaaaatacaaaaattagctgggcatggtggagcaagcctgtaatcccagctacttgggaggctgagacaggagaatcacttgaacccaggaggcggaggttgcagtgaaccactggactccaggctgggcgacagagtgagattctgtctt

SEQ ID NO: 7424 - DNA, 492 bp, Homo sapiens
ccactgcactccagcatgggcaacagtgagattctgtctcaaaaaaaaaaaaaaattatagtaaataaaattacttggtaagaggatgaaattcaaaggaaaatattaaataagtatatcatatattattatttataaattattatatacataaattctcatttccaaaatggaaataatatttcctgcttcatagcattgctatgaaaattaaaggccgggcgcggtggctcatgcctgtaatcctagcactttgggaggccgaggcgggtggatcacaaggtcaggagatcgagatcatccgggctaacatggtgaaacctcgcctctactaaaaatacaaaaaaaattagccgggcgtggtggtgggtgcctgtagtcccagctactcaggaggctgaggcaggagaatgacatgaacccaggaggcggagcttacagtgagccaagatcccgccactgcactccagcctgggtgactgagcgagactc

SEQ ID NO: 7425 - DNA, 637 bp, Homo sapiens
gtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagttcatattcttcacagggacatggatgaagctgggccatcatcctc

SEQ ID NO: 7426 - DNA, 636 bp, Homo sapiens
gtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccgaatactatgcagccatagaaaaggatgagttcatattcttcacagggacatggatgaagctgggccatcatcctc

SEQ ID NO: 7427 - DNA, 687 bp, Homo sapiens
gtacaaaatgcatttgaaactcatgcaataattatcctcagtagtatttcttacagtgagacaacaggcgatgtcagtgagggcgatcatagggcataagcctaagccataccatgcagcctttgtgccagcaaccaaatcccatgtttcctactgtgttaagtttaaaaatgcatttattatagaattgtctacatttctgaggatgtcatggagaatgcttaattttctttctctgaacttcaaaatattaaatattttcttatttatttttttgattaaagtataaattaagacaccctattgacttccgggtaaggggagtcaattgattacccagcagcacagtatttgctttttataattccctttttaaatacttgttcttaattcactggttttccttttctgtcatttttcagagtttagattgtgagtccatgttttgtctgttgtgcctataaaggaaatttgaaatctgtatcattctactataaagacacatgcacacgtatgtttattgcagcactgtttacaatagcaaagacttggaaccaaccaaaatacccacaaatgatagaccggataaagcgtgacacatatacaccatggaatactatgcagccatagaaaaggatgagttcatattcttcacagggacatggatgaagctgggccatcatcctc

SEQ ID NO: 7428 - DNA, 260 bp, Homo sapiens
tcctcagacaacagattggctggaggtttgatgttggacttgtcaacctccagaactgcaaaaaatttctgttacttatttctataatttatgagcacccacttgatgacagtttgtgatagcagcccaaacggactaagacagagataaggaacaagggaaagcaaatcaagtgattctgtgtagagtgtgtctttcatcttcaactcctaagtctggcatagtgtttcacatttagtaagtgaccagtcaggaagtca

SEQ ID NO: 7429 - DNA, 841 bp, Homo sapiens
tacaacagctccagttacaacagctccagttacaacagctttaaaaatattaaatctgctatagcaaatcctactcataagaatcaaatgcagaaacgggctatttggttacatggatatcaggtaggatcagggggcgtgtaacggtacgggggttgagagatggagaataaaaagatttcatgagaaacggttgtaaaagtggtaagaaaacgccccagatgagccattgataacacatgacagcagactggagaagtgagaggaaatgctaaaggttaaaaggggagggaggaaggcattctgaagtgacgccagtatccggttagagtgcgtgggataaggaatgttatgagtattaatcagtggatcaaaaggctaagcgacacatggtgacacaggaagctgtagaataaaactacatcaaaagccgtgagagtaaaagaaaagtgacaggtagtacagatagaaaactgaaaatcattctcctaccacagacctggagcccagcagggagcaattgacattcgctgaggattggcaaagaagcttttcaaatgtaacctggacagtagtactctagtagtcttcacagcaaaccatttagcaaatggtgacgctaccatcacagcttcacaaacaaggaaataatcaagctgacaatgcttcttgaaaaccccaaagctcgggttggtagagcacaccgggtttcttcttcagagctttatttgcgacactgtattcaataaattaattttgacactgattttctactttctactttttgattgttctcatttgtttccacttcatactatgattgttaaaaagtacgcacatg

SEQ ID NO: 7430 - DNA, 587 bp, Homo sapiens
  misc_feature (55)..(55): n is a, c, g, or t
  misc_feature (139)..(139): n is a, c, g, or t
gcgatagtttgctgagaatgatggtttccagcttcatccacgtccctacaaaggncatgaactcacccttttttatggctgcacagtattccatagtgtatatgaggcagctccaattctattatgtcactgacatctntctaggacttttcttacacatcctaaaggactcgacttcatatttacactaacatgagtataatatagaaatattacctctatatgggctgggcgcagtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatga

SEQ ID NO: 7431 - DNA, 795 bp, Homo sapiens
ttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatga

SEQ ID NO: 7432 - DNA, 531 bp, Homo sapiens
ttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcatctcactatgttgcccaggctgatctcaaactcctgagctcaaccatccgctgcctcggcct

SEQ ID NO: 7433 - DNA, 881 bp, Homo sapiens
  misc_feature (71)..(71): n is a, c, g, or t
  misc_feature (92)..(92): n is a, c, g, or t
attcttgttatttgagtgctctttcactctcctccgccatgcccgacccggctaaatctgctcctgccccnaaaaagggctccaagaaagcngtaaccaaggcccagaaaaaggacggcaagaagcgcaagcgcagccgcaaagagagttactctatctacgtgtacaaggtgctgaagcaagtccaccccgacaccggcatctcatcgaaggccatgggcatcatgaactccttcgtcaatgacatctttgagcgcatcgctggcgaggcttcccgcctggcgcattacaacaagcgctcgaccatcacctccagggagatccagacggccgtgcgcctgctgctgcccggggagctggccaagcacgccgtgtccgagggcacaaaggccgtcaccaagtacaccagctccaagtgagctctcgcagctgccagcaatccaaaggctcttttcatagccactcacgcttccagagaaagagcctgtgcattttgcttgtagtcttttgggtggactccggccggcctccattaggagggaagacggcgggaaaagtacagccgtctctgtgtacctgcaaccaccttcgcccagctccaaggaccaaggaaagatggtttctctcttctatggaatcattgcacccatgctgaatccccttatatatacacttaggaacaaggaggtaaaggaaggctttaaaaggttggttgcaagagtcttcttaatcaagaaataagaaatatgcaaatgataagctttgctaaagacaaaatgtttacttagcttactaacttctctgtaagttgccctatttttgttgttactgtagagaacaatgtaaactccctcaaataaaatttccttgatgaagagcta

SEQ ID NO: 7434 - DNA, 2113 bp, Homo sapiens
gagacagggtctcactctgttgcccaaaacggggtaggtacagtggcatgctcacggctcactgcaacctccacctcccggggcttaagcaatccttccacctcagccttctaagtagctgggactacaggcatgcaccaacacacctggctaatttttgtattttttttgttgagacaggtttttcccatgttgcccaggctgatcttgaactcctgggctcaagtgatctgcccatctcggcctcccaaagtgctgggattataggcatgagcctccaggcctgccccaaagatttttaatccacaatttaaggtatgagaaacaaacaaagtggtgtgtatgcagcaagccttgtcactggacaactgaagttgccgcaaagtcaaagcaagtcagtaccctcctgagccagcctttctatgatttacagcaatagtatcatactcaatgctccctagtgacccctccagcttggttaaaatttcacaatagatatatgtgcaaatttaaagaaagtaaagatgttccctttgtacaaaagcctaataaagcaatttctgaaaaaggtgttgttgttgttgttttttagcattggcaaggaactaaaaattctgttctaagcttcacctttcataaagtaatcctctcatgctctttaatcctcaatgttgtaaggtaagtattaaacctactttataggtgaagaactaaggctctgatattaacttgttcaaagacctagccattgagcagaagctcaagaactcgaatttaaattccctttaagtctctattatggggtggtggggatgtagagggggttggaggccgggagactattcgcattctgtatcagaggaaaacgaaagaaaaagagaccaaagctttgaagacttttaaatccaaccctattgtgggcacattccttgtatactgagggcaatggagctacagagcattaacaaatactcatcttcccagatttttttccccatattttatgagctatatttttcctgatatgtttatctttgaagactctttaaaattaggccctattccataatttctatacaacaaaattatgtcctcctgcctacttttaattgaatttaagtctgcgcctgttgtgatgcttctgtgataatccttttgctgaatggcgtaagatctctactaagatccatttggcttaaacctaataaacactagtgaacacatccttaaatgacttttgtttatttcctttaagtaacacttccaaaaaaacaaattcaaggcaattcaatattcagcattagctagacttatgagccattactgaaatttctactgactttatcaaattttttcatggaatctcccaaatgcctatactcacgcataactgttaacacggcatttggtactaaattctcacacataagctttattatattatttaaggtattcttattcccaagaattactatttcaaagaaaaccaagttggtcactttaagcaactatttgaataaatgaaaaactgaagtaattctcaggtgctttgagagttctctgtttaatttaaaaacgttttgggggagaagtaaaatagtggcctttgaaaaaatatgctgacacaagacatattgaattttgtggttttaaaaaattaacaaataatgaacttggcattttattaaatgcatcgaaaagggtcaagttatttttaatagaaaatccataattctattaaatggttgagaaattagtcacatcaatagacttctttcatttctgagcccatcttctgtactgctacaagttcctttggcaatgaccactttgctgtaaacattcttagaaaagtaggaattaggcttggcgcggtggctcacgcatgtaatcccagcactttgggaggccgaggctggtggatcacgaggtcaggagatcgagaccatcctggccaacacggtgaaaccctgtatctactaaaaacacaaaaaattagccaggcgtggtggcgggcgcctgtagtcccagcaacttaggaggctaaggcaggagaatggcgtgaacctgggaggcggagcttgcagtgagccgagattgcgccactgcactc

SEQ ID NO: 7435 - DNA, 554 bp, Homo sapiens
ttttttttttttgagacaaggtctggctctatctcccaggctacaatgcagtggcatgatgccactctctgctcactgcaagctccacctcccaggctcaaaccaccctttcagactcaagccatcctcccacctaagcctcccaagtggctgggacaacaggtgcacaccaccatgcccagctaatttttgtatttttttgtagacacagggtttcaccatgttgcccaggctagtcttgaactcatgagctcaagcgatctgcccgcctcagcctcccaaagtgctgggattataggcttgagccagcacacttagcctaaaatactgtaaattttatttgcacaattctttcaagcagcagctaggttttaaaaccaccactgggatattcttttctacagacattcccttctatacacctctgtattaagctagacaatttccttggacaaaaatttcatagcatgttttatttttcatttcctttttaacatacatacacgattacatcattgttattgtcgacgcggccgcgaatttagtagtagtag

SEQ ID NO: 7436 - DNA, 327 bp, Homo sapiens
ctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaatt

SEQ ID NO: 7437 - DNA, 366 bp, Homo sapiens
tgatatatattatactaattttctattaacatgtaacaaattcccataaacttaacaacttaaaaccacatttattaatcagcttatattactgtaggttagaagtcctgcataggcactttgggaggccaaggcaggaggtttgcttgagctcaggagttcaagatgcgcctgggcaacatagtgagaccccatccctactaaaaatcaaaaaaattagtcaggcatggtggtacatgcctatagtcctagctacttggaggctgaggcaggaggatcacttgaacccatggggctgaggctgcactgagtcatggtcatgccactgcactccagcctgggtgagagatgagaccagtctcaaaa

SEQ ID NO: 7438 - DNA, 491 bp, Homo sapiens
gctttgcgccagtaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggacaagtcttaaagccttacagcatcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaact

SEQ ID NO: 7439 - DNA, 518 bp, Homo sapiens
gttctgtttttttgtggaaaaggggaaactgatgggctgatttttttgtttctgtttttacatcatagataatcagagttatttttcattacttatcattggtagacttcttactagtttgatccatgctatagtctgaatattgcgtcccccgcccctccattttatatgttgaaatcctaacccctaaactgatggtattaggaggtcattcctttgggaggcgattaggtcatgatggcagagccttcatgaatgggattagtggccttaaaaaggaggcctgagagagaccctcactccttccactatatgaagacacagcaagaagtcaccctctctgaactagaaagaagacacacacacacacagacgtggaatctgctgttgccttgaacttcctagcccccagactataggaaataaaaatttttttttttttttttttgagacagagcctcactctgtcacccaggctggagtgcactggcatgatcttggctgattgcaacctccac

SEQ ID NO: 7440 - DNA, 501 bp, Homo sapiens
tgcccgccttggtctcccaaagtgttgggattacaggcatgagccaccgtgcccagcctgaacatagtttaatggtacttcaaggctaataaggaaagccccttgctccatcctttcctattcctcagtcccatcccaagagacattcagccttcagttttttctagctcggttctttcagccttcagtttttggttttaggtttctaaataatatgattatacagccatttattttttaggtgtttgtcaacttactattaagacaggtgaaaatttcttttattgtttcacatccttctaatattattttggttagatcatgtacctgtttgcatagctgtgatcatacttgtatgttcactcatgaattaatttaatgtgcttacattttcattctcatacaacgttttgtcttggagttaatgctcttttttttggctttttatgcacatcattgattcttcccaaacagtcccaaataaattatgtcacaactttt

SEQ ID NO: 7441 - DNA, 740 bp, Homo sapiens
agcgggcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcgattatagatccagactcctgtgcctgaccactgcccatggccaactctctgctgatgactggacttgactacacaagttgttggccatcttaaaaccactcaaagttgacggtctcctctcctgcctcctgcggcttccattaccatggcagagactgtggtgtctgaggtggtgtagcgtactgaagcaaggctgtcttgaagaagaggagacaactcacaattctaccacctttgttgacctcttcttctcccccagcttattgctgtagaggctacctgagctcattgtccctggagatggaccaaatagaagaataagcagtgcctgtgtggtgagcttcaagaggcatctgttctctggggagtgggtgggtggtaaagcaaagacgggagatgtgtatattagctatccattactgtataattaattatacacaaaactaaactatacactaaactaaaacttcacagcttaaaacaggaaatatgtattatctcacacaatttctgagagtcaggaatctgaaaatggcttagctagtttggttctggctcagggtgacctatggagttgcagccaagatg

SEQ ID NO: 7442 - DNA, 935 bp, Homo sapiens
gaaagaacctgtttaaatttccatgccaatttgcaacccccatactgtgccagattatagatccagactcctgtgcctgaccactgcccatggccaactctctgctgatgactggacttgactacacaagttgttgggtactttgactagaacaccaaccaagtcattggaaatataatgctttgttctttctagctccaagatatgaacatgtgacaacccaaacaaacaaaatcccaacaaggttgtcagatatgcaaattacagttgacccttgaacaacagagagggtagaggtgctgatcactggcacagttgaaaattcaaaagttttgactcccctaaaacttaattactaataacctactgttgactagaagcctactgataatataaacgatttattaacacatattttatatgttatatgtattaggtactgtattataataaagtaagctagagcaaagaaaatgttatggataaaatcataagaaagagaaaagatatttactctccattgaatagaaatggctcatcataaagatcttcattctcaccatcttcaaattgggtaggctgaagaggagcaataagagaaggggttggtcttgccatctcaggtgtggcagagacggaaaacaatccacgtataaatatggacccatgtagttcaaacctgtgttgttcaaaggtcaactgtatttactttaaattacttgtctgacctgagattttcctgaccataatccaagagattgacacctttctaaagtttgttcttatgttttccaaaatgacaacttgttttccagaagttagcagccaccatgttttaagacagaaacagcctgaggttctcccaaggtctattgagcataagagttttttgccttctagtaaaataaacccatattcgcagagtgtctggacca

SEQ ID NO: 7443 - DNA, 640 bp, Homo sapiens
agcgggcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggcgccatcttcagctctgagtcaccagggctggaaaaatactagatgcgctactcgtggactcgtgaatacactcgtgaatacaggccatttcctgtacctacagccacccgctccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagacgaacctgttggagaatgtactccttggaaataaggaagaaagaggatccagggaacaggagtttcaccacagaggagcaggaaagggaattcccagtatgatggcaagttgctaaattaaatgttttgcccattat

SEQ ID NO: 7444 - DNA, 722 bp, Homo sapiens
agcgggcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcgattatagatccagactcctgtgcctgaccactgcccatggccaactctctgctgatgactggacttgactacacaagttgttggccatcttaaaaccactcaaagttgacggtctcctctcctgcctcctgcggcttccattaccatggcagagactgtggtgtctgaggtggtgtagcgtactgaagcaaggctgtcttgaagaagaggagacaactcacaattctaccacctttgttgacctcttcttctcccccagcttattgctgtagaggctacctgagctcattgtccctggagatggaccaaatagaagaataagcagtgcctgtgtgctgaaggtaaagaaatttcatgtggtggattcctacaaaagaaaaagctgcaaaagagtcaaccaggaaaggtgctagacacacatccaatggctgctgagtgatgaatgagaaagaaaccttcggtgtagtaagccattgaaatttgggggaaatttgtaatagctgttgctgtaaacctccgcactgcaaaacacacacatcctagataattaaaagacaacttctaccagat

SEQ ID NO: 7445 - DNA, 567 bp, Homo sapiens
gtggcaattgtgaatgggattgcctctctgatttgtctctaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaagcaatttacagattgaatgttatttctatcaaactaccaatgacatttttcacagaactagaaagaactattttaaaattcatatggaaccaaaaaagagtctgaatagccaaggtaaccctaagcaaaaagaacaaagctggagacatcccagtatttgacttcaaactatactacaggactacggtaaccaaaacagcatggtacttttttacaaaaggagacacatagaccaatggaacagaatagagagcccagaaataatgccagacacctacaaccacatgatctttgacaaagctgacaaaaactagcaatggggaaaaagctccctcttcagtaaatggtgc

SEQ ID NO: 7446 - DNA, 548 bp, Homo sapiens
agcgggcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggcgccatcttcagctctgagtcaccagggctggaaaaatactagatgcgctactcgtggactcgtgaatacactcgtgaatacaggccatttcctgtacctacagccacccgcttttcttctcccagtgacctctattaacagagcctacatggaaccagccggcaaagacaagttccactgtcacaactagagaaaagaggatgggtttggaattgaaaggcttggctgttgttgatataaaggaatgcagctaaccagggagatggaaaatctctacagtgagagccacaaaacacttctcaaagaaatcagagatgacacagacaaatggaaaaacattacatgcttatggataggaagaatcaatatcattaaaatggccatactgcccaaa

SEQ ID NO: 7447 - DNA, 764 bp, Homo sapiens
agcgggcctccaccgccttcttccaggaggaggggccgtgcggcgcctgcccgggggccctcaggccgcaggcgggcgcgagcttcagggaacttagggggctcccgcctccccggccacgcgagcgggaacagtctcctccactcggagcggcgccatcttcagctctgagtcaccagggctggaaaaatactagatgcgctactcgtggactcgtgaatacactcgtgaatacaggccatttcctgtacctacagccacccgctccactcatcatgccttacctggatgatgcagaagtccctggaaacagaaggtctcacccttctttatctttctcatggctttccaaggctctttatcatgttactttcctgctcagaattctttaatgacttgcctcaatgaccagatacatgtgatctacagtcagccttccagcctcatcattcctcttccatttcctccccagaaacactgtactttatgaagctcctccaagactgctctctcagcagctgggacccggtcttggaatcttagtgtcaactatgatgaatcaccaacactaacaaaaacattatcttttattgggttaaatagtttctactcttcccaagactgggaactgatgtaacaggcttcgtgctttcttcccaacaaattgattctgtgtggtcagctcctgtcatgatgatagaaccccctgtattgatttatacttaggggtatatcaatgtcagtctaaacttgtcctacctact

SEQ ID NO: 7448 - DNA, 429 bp, Homo sapiens
agggacccagataagtagggcttgaagtgaatccccagcaaactgcagcagccctacagaagaggtgcctgactgttcaaaggaaaacagaaagcaacaacaacatcaaccaaaaagtccccacgaaaacctcatctaaaggtcagcagcctcaaagatcaaaatgagacaaactcatgaagatgagaaaggaatgaaaaacccctcacaactcaaaaggccagagtggcttgtttactccaaatgatcacaacacctctacagcaagggcacagtgctgggaggaggttgagatggatgaattgacagaagtaggcttcagaaggtgggtagtagcaaacttcactgagctaaaggagcacgttctaacccaacacattggaacgaatcccagaacttaaagattggttctctaaaataagacagaca

SEQ ID NO: 7449 - DNA, 2664 bp, Homo sapiens
gggcgagcgcgacgcgggagccggggcggcgcgggcagcgcgggccggccgggctgtgcggggcgagcggcggcgcggcgggggccttcggccggggcggcagctgggcgccggcgggagctagcagcgtctgcagccgcgcccggccagccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctcggtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgcaaaaaaac

SEQ ID NO: 7450 - DNA, 2929 bp, Homo sapiens
gggcgagcgcgacgcgggagccggggcggcgcgggcagcgcgggccggccgggctgtgcggggcgagcggcggcgcggcgggggccttcggccggggcggcagctgggcgccggcgggagctagcagcgtctgcagccgcgcccggccagccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctcggtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatggtacatctcaggggcccgcggtgagaggcgccaacaacgacacgacatcacacacaaacaccacctgtgtgtggccgcaccgtcgcccctgaaaaaaacgttcagaacacaccttcgggtgtggccccggcggcccacatggtaagcgagaaccgtggcaccacagggggctcaaaaaagaacactgggcaccgaacaacggcgtggtctccaccaaaaaaacagcccgggggcaccggccgctctgaaccaccagaggggcccgcagccacgggcacacacgggccacgaagcaaaaatga

SEQ ID NO: 7451 - DNA, 1853 bp, Homo sapiens
gggcgagcgcgacgcgggagccggggcggcgcgggcagcgcgggccggccgggctgtgcggggcgagcggcggcgcggcgggggccttcggccggggcggcagctgggcgccggcgggagctagcagcgtctgcagccgcgcccggccagccggcgcgctccggctcggccatggagctgccagctgttggcgagcacgtcttcgcggtggagagcatcgagaagaagcggatccgcaagggcagagtggagtatctggtgaaatggagaggctggtcgcccaaatataacacgtgggaaccggaggagaacatcctggaccccaggctgctgatcgccttccagaacagggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccacacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctcggtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgcaaaaaaac

SEQ ID NO: 7452 - DNA, 2672 bp, Homo sapiens
cgtgtccactttgcttcgcacagagccacaggcccaaggccgtgggcgggagggccagaggtgcagccctgagcttctgcctcctgagcacagaggtggggcttgggggggtgctggttcgggtgtgggcatcaaagtgggggagccctttgcccaggacctcttgggcagaggagggttggtgtgagggttaagggcgcagaggcctgacctgccctgaactcttgattcctgtgtccggccagccctacctgatgctctctgaagcgggggggggggcttcacagaagattccggaataagcgggtagggggcgaccctgaggctaacagcactgccctctgttccctcccacccaggaacggcaggagcagctgatgggatatcggaagagagggccgaagcccaaaccgctagtggtgcaggtgcctacctttgcccgtcgttccaatgtcctgaccggcctccaggactcctccactgacaaccgtgccaagctggatttgggcgcgcaggggaagggccaggggcatcagtacgagctcaacagcaagaagcaccaccagtaccagccgcacagcaaggagcgggcgggcaagcccccgccgccgggcaagagcggcaagtactactaccagctcaacagcaagaagcaccacccctaccagcccgaccccaaaatgtacgacctgcagtaccagggcggccacaaggaggcgcccagccccacctgcccggacctgggggccaagagccacccgcccgacaagtgggcgcaaggtgcgggggccaaaggctacctgggggcggtgaagcccctggccggtgcggcgggtgctccaggcaaaggctccgagaagggcccccccaacggaatgatgccggcccccaaagaggctgtgacgggcaacgggattgggggcaagatgaagatagtcaagaacaagaacaagaacggacgcatcgtgatcgtgatgagcaaatacatggagaacggcatgcaggcggtgaagatcaagtccggcgaggtggcagagggggaggctcgctcccccagccacaagaagcgggcagccgacgagcgccaccctcctgccgacaggacttttaaaaaggcggcgggcgcagaggagaagaaggtggaggcgccgcccaagaggagggaggaggaggtgtccggggttagcgatccgcagccccaggatgccggctcccgcaagctgtccccgaccaaggaggcctttggagagcagcccctgcagctcaccaccaagcccgacctgcttgcctgggacccggcccggaacacgcacccgccctcacaccacccgcacccgcacccccatcaccaccaccaccaccaccaccaccaccaccacgccgtcggcctgaatctctcccacgtgcgcaagcgctgcctctccgagacccacggcgagcgcgagccctgcaagaagcggctgactgcgcgcagcatcagcacccccacctgcctggggggcagcccagccgctgagcgcccggccgacctgccaccagccgccgccctcccgcagcccgaggtcatcctgctagactcagacctggatgaacccatagacttgcgctcggtcaagacgcgcagcgaggccggggagccgcccagctccctccaggtgaagcccgagacaccggcgtcggcggcggtggcggtggcggcggcagcggcacccaccacgacggcggagaagcctccagccgaggcccaggacgaacctgcagagtcgctgagcgagttcaagcccttctttgggaatataattatcaccgacgtcaccgcgaactgcctcaccgttactttcaaggagtacgtgacggtgtagccggagggcgtcggaaggggaagcgccattcccgcgggggggcggggagctgagcacctggggcctcggggcgggctcccctctcgccaacccgccaaccgcgagagacccaggctggcccccagggtgaggacgcccggagcggaggtaaccatgttccccctgcggcggctgtcagacctgggcggaggccccttccacgcggtgccggcggggctcgccctctcctgcccttccccgctggagatggacccccggaacggacagggcagctctgcgcccggcctcagagttctagtattatattttaaccgtgctaacttgtcaagtgctgactctactcccgtttgtacgtggtgttattattgaaatgtattgtttgagctcaaaaggcccgaccaccccccttcgggctgctatatatatatttatttgtaggtatttatatattgaaatataaaaacctagatttatggagtttcctctagatcatgttatattctatatcagacaaactattttcttttgacctttcttcccctccatccagtatttcggttgatttcattttctcccctctcttccccttccacgaactgcaataccagtaaccttggtatatattttttgatactgtacacatggatgtcttgtttctatgtgcaaaaaaaaaaaaaaaaaaaagtttgttaaaaggctacacgagctctctagaaactgctgctactagaaatgtctaaactataagcttccaactattacctgcttgaatgtaaatattaaatggagatgttgaaggtgcaaaaaaac

SEQ ID NO: 7453 - DNA, 403 bp, Homo sapiens
caggcaggtttgtacaggttttgctgcaaaaatgaggagtgtgtgtgcatgtgcatactgttttttccttcagtagcagtaatattttacccttaaaaatgcctcttgaggctgggagcggtggcttatgcctgtaattccagcactttgggaggctgaggcagatggatcacttgaggtcaggagttcgagaccagcctggccaacatggtgaaaccccgtctctactgaaaatacaaaatttagccgagtgtggtggcgggcgcctgtggtcccagctactcgggaggctgaggcaggagaatggcatgaactcgggaggcagaggggcggagggtgcagtgagccgagattgcaccactgcactccagcctgggcaatagagtgagactcagtctcaaaa

SEQ ID NO: 7454 - DNA, 269 bp, Homo sapiens
gaaagtttgctgcgtagggatagggagaccgggccggattgcggggagtgagcaggttcagcagtgacggcattcttaagagtcctgcccaagtgagggacttggggtgtgggacagagtggcccccagctccagccgccggctcggactcggtctctgacccccaactcggtcccctagtccggccccggctccgggccccccaaccctcgctccggccggcccggtccccacaccagcccatgccgaccgcacccagggccctggcc

SEQ ID NO: 7455 - DNA, 1260 bp, Homo sapiens
ggctgtaccggtctggagttgtaagggatcttccctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctga

SEQ ID NO: 7456 - DNA, 1529 bp, Homo sapiens
  misc_feature (1303)..(1303): n is a, c, g, or t
ggtgtgtgtttctggccggagccgtttcgcgacggcccgggcgccccgccccaaccttccttccctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctgaaaaaaacacaaanacaacaaaaaaaacctttttgcgcggcctcggcccatgaagagggtctctaaaccccaatcgtgtggcgcccgccccaagggtagctgaccctggccaaaggccgctccaagggaaccctgccaggactaggggtgggttccaccaaaaaagccgcgggggaccggggtctgaacaaccatggggctgcgccttggttacaccgggcaggtctctccccccgaggt

SEQ ID NO: 7457 - DNA, 1197 bp, Homo sapiens
ggctgtaccggtctggagttgtaagggatcttccctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctga

SEQ ID NO: 7458 - DNA, 1290 bp, Homo sapiens
ggtgtgtgtttctggccggagccgtttcgcgacggcccgggcgccccgccccaaccttccttccctagaccctcttctctcccttcggcttctctctttcggccggcgccgccagttcctggggcacacccagaggtccccttctcgccgccgcctgcaactgcgagggtagcccggggccgcttggagtcgcccggacctgagaggctgctgcactgggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctga

SEQ ID NO: 7459 - DNA, 1760 bp, Homo sapiens
gaaagtttgctgcgtagggatagggagaccgggccggattgcggggagtgagcaggttcagcagtgacggcattcttaagagtcctgcccaagtgagggacttggggtgtgggacagagtggcccccagggcagtgggcgttggaaactgagaggccctgcgaaggaggcttggggaggggctacggtgaccaggggacgaggtataggaagaggagggcggaaagccttgagggtgggcttcttggatcccaattgccccagaggcacaggcctgggcatcactgtattatttcccgaggggagaaggggctatttcccatgggaagacaaagtgggatgaatagtggaccttgagaagagggggtggccaggaaaaggttcctgaaggaggcaggacccagactgcaggctggggagggtttgggcagccagagggaggtgagggtgctggagcgggggtcaatcggtcactccggccggagatctgagtggcctctgccccctctgcgctgtggagtgcatctgattgccagcctcgctggaccgttgagaggattcatcgagaccctggatatgaatatgcagtgtgaactgaagtttggggacatgagtaatcagtcacagtggcccaagatttgaggtgtaaatggagaagtcagaatgattcgctgcagctgtctggaacaggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctga

SEQ ID NO: 7460 - DNA, 1104 bp, Homo sapiens
gcgggcggcgggaggggctggaccgcgtggagggcctcagccagccctccggatgctggtgctgccatccccctgccctcagcctctggcattttcctccgttgagaccatggagggccctccccgtcggacttgccgctccccagaacctggaccttcctcctccatcggatctccccaggcttcatctcctccaaggcccaaccactacctgcttattgacactcagggtgtcccctacacagtgctggtggacgaggagtcacagagggagccaggggccagtggggctccaggccagaaaaagtgctacagctgccccgtgtgctcaagggtcttcgagtacatgtcctaccttcagcgacacagcatcacccactcggaggtaaagcccttcgagtgtgacatctgtgggaaggcattcaagcgcgccagccacttggcacggcaccattccattcacctggcgggtggtgggcggccccacggctgcccgctctgccctcgccgcttccgggatgcgggtgagctggcccagcacagccgggtgcactctggggaacgcccgtttcagtgtccacactgccctcgccgctttatggagcagaacacactgcagaaacacacgcggtggaagcatccatgagccgggctgccgggtgccccaggtaccacaggactttgcagggagcctggactcctgtccagacacctggtgagagcctgaggctggtgttcagggccctggacacagacacagagcagccgcatctcaaaggcagagccctgcctgaaggaggaatccgtgagtaatcttcaggtcctccgtgttctggagctgagatgggaatgagcccctacacagaatggagtcctctagcctaaagatatcagctgttccatggcagagccttgactggatggaggtggggagtgtggtgtgtaaagtctctggcctcataaaaggtggctgtgggtcgtcaggaatctgcgccatcttcctggggcttctgcgctgttgttggggaagggaccccagtcctgccttccaccccccaaccaggcctgagactgatcaaacaataaacacgtttcccactctga

SEQ ID NO: 7461 - DNA, 541 bp, Homo sapiens
cttcacaagagaaaatattatcaacaaacttatggaaaaatcagattcatttttaatcaggaaaatgcaaatgaaaaccatatcagaatggctaaagttaaaaagactgacaatataggtattgaggcagtaaaccaatggaagctgtcacgtactgctggtgagagtataatttggcacaaccactttggaaaccagtttttgatctagcaatcccactctgaggaatattctctgtttaaatgcatggacttgttcatcaagatacagtttataaaaatgctttggtgggatgcagtggcttatgcctgtaatcctagcactttgagaagccgaggcaggtggactgcttgagcccaggagtttgagaccagcctgggcaacatggcgaaaacccatctctacaaaaaatacaaaaaattagctgggcattttggcgcatggctgtagtcccagctactaggaaggagaatcacttgagcccagaagttgacttgctgtgagtcatgattgtgccactgcattccagcctgggcaacag

SEQ ID NO: 7462 - DNA, 419 bp, Homo sapiens
tttcaccatgttggtcagtctggtctagaactcctgacctcaggtgatccgctggcctcaacctcctgaagtgctgggattacaggcatgagccaccatgcctggcctctaaattgctcttatggagactcattttcatggttaaaatgtcctgaattgactgtggcttgttggtgggaggagggatggaggaagctacttatggaaaatgaacaaggaagggaagcacaccagaagctagaaagtgtcatcaatttttacatcaaagactccatgacaaagagaaagtacaagtagcctgtttttgtagctgaccattggactgcggactgcacatgcagctaccaggttcttctggatagtcccagttttaaatttttgacctgatattcatgaacatagtgctactggtcagacct

SEQ ID NO: 7463 - DNA, 395 bp, Homo sapiens
aagaaatcctggaagggcatctcccagctctgagactctctgatgctatgaattcaagttattctgtccatgactgggtctggaggtcactgtgtaaaatctacgcttctaaataaatgttatgatatctcagcatactataccatacttataacatgtatgcttataacagcatactataccatatagtatagttcccaagaaaagggaatgtttcttcccccctaaaaaaaggaaaattcccattatctaatatataaaacaaacttttttgatgatttaaagtgactgtgtgttgtgaactgagtagacaaggcaggaaggagtagtgatgttcctgagttcttgctgaattctgacaacgtgccaacactttgatttctctgtcaaaatgg

SEQ ID NO: 7464 - DNA, 591 bp, Homo sapiens
ggtttttccatggtgaagtttggaaaactgagggtctgagtccctcatttggtggtattagaatttaactgagtaggaggagagaagaaaacagtaacaaatgtcaaaatttcaagcaaccatgtggtatggctgtggtagagatgtatcaggcaattgaaagttttctaggtggtgccatcttgctaaaataataaaaagtacaggtttataaatcaaaaacaagtgcaatctatgtagggaaggattgtctatggatatacaagtggccagtgcaggaagtgaagtaacatttatctttatcttaatttctatgctcatgtcccccattccccttctgaagccaggcctgggaccttagatagcagcttagagggtctggccctgatacatttactcctttaattttggaatttccttctagtctctcaagagtgtttgtggcatatatttttcattttataaatataaaattgtacaaagtaatgtacattttgttttagagaagtcttttaaatgtttgcagacagcccagatcgtccatccctatttaggcagtggtctccaaacgtttatgtttattcaccctat

SEQ ID NO: 7465 - DNA, 237 bp, Homo sapiens
acaagaatagaaactattttgaaatttacaaaatgctgagaaatggaagaaatcaaagacctaaaaaatcagagagactttggggatcagaaaacccagaaaggttttttttttttttttttaaatataggtactagacctagacagtctcattctgaaatgtagatggcatagcacaggacctataataactaaaacaactctgaaaaagaagaaaaaagtaggaggaatcattgt

SEQ ID NO: 7466 - DNA, 2035 bp, Homo sapiens
  misc_feature (44)..(44): n is a, c, g, or t
  misc_feature (997)..(997): n is a, c, g, or t
ggcttggcaatgaggccgaactcctggagagcatgggggatgcnccgccgccccaggacgagcacaccaccatcatagaccgcggaccgggggcctgcgaggagagcaaccatctcctgctcaatggtggctcccacaagcacgtgcagagccagattcacaggtcagccgactccggggggcggcagggcagagaacagaagcaggaccccctgcactcgcccacctccaagaggaagaaggtgaaatttaccacctttaccaccatccccccggacgacagctgccccacggtgaactccatcgtcagcagcaatgatgaggacatcaaatgggtgtgtcaagacgtggctgtgggtgcccccaaggaacttagaaactatctggagaaactcaaagataaggcttaggcccctctagccaaagggccctgcccagatgccttccttgtactggaaactggcccaagtggggcagaaggcgttgtcagtggggttaagaagggacggtcccagggtccatgctagaccagttggaaagttttgaagtcaggaaaagacgtttttgtatcaagggatttttagcagttaatggtggtggatttttaaaggtcaggggaataaagtctggggcatggggagtgcagaccaagttactgaactgcacaggcaaaattaggaaggttattttatgagtcaaaacatactacagacaagctaccaaaaattatttgttaaaaaatgcaacaagacaaataaaaagagaaataatcatctgtttatatttctaataaaggagcaaaatataaaaataggacctgctaagagacattttccattctaattcacgattcacttttccaaggacagccttcaactgtcaccacacagctgggggggagtcatttcttaacaagggatgcctcttgggatagaactagggagttttaaatctttacttgatcatcttttattttcttttccactttttccttttntctctctctctgtgtcctagacttccattgcatttatatttaatgtttatttctgagaatcaagcagtatatttttcctaaatgaaacataaattatattcctattcattagataggttcctaggaacaatgccaattaatccattgtttaagtagtaacttgaatgtttttctatatccctccagctttgttgatagtggcgggttttgtacaattggagggagccctcagagccttctgggggaggagaggaactgtccttaatccatcaccactaccatagggcaaagccagcaggtgtggccctgtgaggggctgtacagacgggatgtggccaggagaacagagccccacctggaccacctgacccctcgggattccacccctgtcatcgtggggatgttcctatatgggagaaagttgggttaaatcaaaaaagaggccacgcccaggtgtaatcagagccaacctggtgggctgggtctatcacaagacataactgatgctgaacatgaacaaagataaaaactgtttggagggtttttgagttgtttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgccagtgaaataagccccttcgtgatcacctgactccagttctccgtgtgctccattggctgcggctgcaggaggaagatgcctgacagccctcatgctctccgcaggggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatatttatttatacctgtgatgccaattgtcattaaaaggcttttcatggcttgacaagtcagaaac

SEQ ID NO: 7467 - DNA, 2132 bp, Homo sapiens
  misc_feature (1094)..(1094): n is a, c, g, or t
gagatcaaaggaaagatggatgcggtggtgaacttcacataccagtacctgagcgcccccctgtgtgtcaccgtgtgggtgccccggctgcccctgcagatcgaggtctctgacacggagctcagccagataaagggctggagggtccccattgtgaccaataagaggtgagcgttgtgcagatgaactttgaaatagccagtttcagcagcctttcagggactcagcccatcacgtggcaggtggagtacccacggaaggggaccacagacatcgccgtgtccgagatctttgtcagccagaaggacctggtgggcatcgttcccttggctatggtgagtgaaatttaccacctttaccaccatccccccggacgacagctgccccacggtgaactccatcgtcagcagcaatgatgaggacatcaaatgggtgtgtcaagacgtggctgtgggtgcccccaaggaacttagaaactatctggagaaactcaaagataaggcttaggcccctctagccaaagggccctgcccagatgccttccttgtactggaaactggcccaagtggggcagaaggcgttgtcagtggggttaagaagggacggtcccagggtccatgctagaccagttggaaagttttgaagtcaggaaaagacgtttttgtatcaagggatttttagcagttaatggtggtggatttttaaaggtcaggggaataaagtctggggcatggggagtgcagaccaagttactgaactgcacaggcaaaattaggaaggttattttatgagtcaaaacatactacagacaagctaccaaaaattatttgttaaaaaatgcaacaagacaaataaaaagagaaataatcatctgtttatatttctaataaaggagcaaaatataaaaataggacctgctaagagacattttccattctaattcacgattcacttttccaaggacagccttcaactgtcaccacacagctgggggggagtcatttcttaacaagggatgcctcttgggatagaactagggagttttaaatctttacttgatcatcttttattttcttttccactttttccttttntctctctctctgtgtcctagacttccattgcatttatatttaatgtttatttctgagaatcaagcagtatatttttcctaaatgaaacataaattatattcctattcattagataggttcctaggaacaatgccaattaatccattgtttaagtagtaacttgaatgtttttctatatccctccagctttgttgatagtggcgggttttgtacaattggagggagccctcagagccttctgggggaggagaggaactgtccttaatccatcaccactaccatagggcaaagccagcaggtgtggccctgtgaggggctgtacagacgggatgtggccaggagaacagagccccacctggaccacctgacccctcgggattccacccctgtcatcgtggggatgttcctatatgggagaaagttgggttaaatcaaaaaagaggccacgcccaggtgtaatcagagccaacctggtgggctgggtctatcacaagacataactgatgctgaacatgaacaaagataaaaactgtttggagggtttttgagttgtttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgccagtgaaataagccccttcgtgatcacctgactccagttctccgtgtgctccattggctgcggctgcaggaggaagatgcctgacagccctcatgctctccgcaggggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatatttatttatacctgtgatgccaattgtcattaaaaggcttttcatggcttgacaagtcagaaac

SEQ ID NO: 7468 - DNA, 474 bp, Homo sapiens
  misc_feature (85)..(85): n is a, c, g, or t
gtttcaggttggttcaggtcagaatttgcagccagctgagttcacatcagatcaatttgccagcaagtgagttaagaaaacaaanaacaagtttgttctcagagcatttatgactttagagttgtctatcagcatttgtggacctataatgttttgttcattaatcaaaaccttctgtaattgtttagcaaatggttatatcatttctaatttcaagtggacaggtagaaattatttctgctttcctcatttcccctggaaaaaaagaaaaggcagatatctgaacagagtttgaggatgattaaatacaggttgagcattcctaatctgaaaatccaaactccaaaatactgccaaatccaaaactttttgtgtaccaacaagaagctcaaaggaaatgctcattggagcatttcggatttctgatttttggtttaagaattctcaaccagtaagtatataacgcaaacattc

SEQ ID NO: 7469 - DNA, 373 bp, Homo sapiens
ctaggagaggatgtgtactggccctcagggaggaagatgccagccacgctgtgctgacatagcagggactgccgactggagccctgagctgtgctgccatttgactctctggcctgatgaggtgcgacagagatgtcaattttctggaacattgcacagatcacatatttatgcaaatgcttttctgtatctacaatcaaaaatggtcatctcagagaaggaaatttactaagccaacagaaacctcaatttttacaacttaaatgtggctctttccctctctgacaccaaaatagtttcaaaagctaggaagtcattaagaatggcttgtctgtcattcctacttagacaaggtgtgggattgataaggaca

SEQ ID NO: 7470 - DNA, 506 bp, Homo sapiens
ccacaaagtaagaaaccatttcttgccgggtgtatgaaatagatcactgggttattttttaaaaatcatcttttgagtagaatatggctggaaatttatggtgaagatttaaaaattttcagcttttttttgttgtagcaagtcctcttaaaatccacttttagacacttcagcaatacagacctgaagtccaaacctagagctagcagcagggcaacaaactgcccttatttgccaagacagggctttcctgggacataagactatcggtgctaaaactgggagaatccggggcaaatcaggacagttggtcactccagatgtctaacaaaatgactcttaatagaaagtagctgtcacattgatgcattgttaaaatataaattttgagtgaaccaaataatgaccatatcccataatatttgggttgaaaatgggggttaatccaactcttggaaaatctgtagccatatatgcatgtttgttcagaccagcttaaaaagaca

SEQ ID NO: 7471 - DNA, 455 bp, Homo sapiens
  misc_feature (279)..(279): n is a, c, g, or t
  misc_feature (361)..(361): n is a, c, g, or t
aatgattcccgtttttcaaacaaacggtgaaataaggacaataaaagaggttatctgaggccctcagcaagcaaccactggaatgtgggttttattggttcaatctagtgctcatttctactatatgactactttattttagcaaagcatttgataatttttggtgatgtgctatgggaaagatagaataatgtaagctacataagattcagaatgtgggttttattggcttaatctagtgctcatttctactatatgactattttagcaaagcatttngataatttttggttatttgctacgggaaacatagaataatgtaagctacataagattctagttgaaagattcatacatggtngaaaacctatacatttaactcaacaaacatttattgagcacttcttatgtgctgggctctctagtaggtctatagaaactagtatattaatgcc

SEQ ID NO: 7472 - DNA, 786 bp, Homo sapiens
taattctcaactgtaagttgatttattgcaaggcaggattccctggatatatgaagaaattatccctattctgcagcagaaggaaaggatctctcttagtgttgcacagtaaaagttgaaacaatacacttgtgagtggaattctgaagacatcacttctgtgatttttaaaccacttctaaatcctttcctcttttgtttgtggtgggtaattaacttcactttttggtatttaatggagctaaagtttatttttaaacgggaactagttcagttttccgaactaactaaactttttgtggaatactatcttttgataccagcagaatattaagtttctttttattaactaaatgattaataagcaatgtttacatggagatactgtttagggacataatgagtttttcacagttcagtgttagaaacaaatcataattcagtaaactaagaactattttagaagtttgttttgaagtggtaaagaagggattaaaggcctggcgcggtgggtcattcctgtaatcccagcactttgggaggctgaggcgggcggatcacttgaggccaggagttggagaccagcctggccaacatggcgaaaccccatctctaccaaaaacacaaaaattagctgggcatggtggcacatgcccatagtcccagcttcttgggaggctgaggcataagaattgcttgaacctgggagatggaggttgcagtgagctgagatcgcatcactgcactacagcctgggtgatagagcaagactgtctgaaaaaaaga

SEQ ID NO: 7473 - DNA, 321 bp, Homo sapiens
gctgaggcaggagattcgcttgagctcgggaggcagaggttgcagtgagcccaggtcacgccatggcactctccagtctggatgacagagcgagactctgtctcaaacccacaagacctctctctcccgctagtctataaagcttcttgacgataaggcttttgtgcttgttagtgaatactagtcctgtttctcctacctgacacagtgaacgctcataagatgtttgagtgctcgcatgaatgaacgaccagacccgactgaattattttttttcttcaggctcctgagtctggtcgacactttcagagtagacgtttc

SEQ ID NO: 7474 - DNA, 569 bp, Homo sapiens
gcaaatgccacataatattttccaaacttgaaaagtaaagtccatattccaatttaaaaattaagcttcttttattttttatacagtacacatatcacttgggaacaaatatgccaatggaacagaagtacaatgtagttttcaattgtcctgtaaaaatattgcacgattccatgcaaccaacttgtgatattaaaatggcagtaaaaccaaacccaaggattagtacgggaatgtcatagtatgtcatacctcagcaaccctcattccacctcatccaattccaataggagtttcagagctacaagagtcacttcagtcatgtatattatagtccaacagcccctccctcgactgaggaattcctagcctgctggtaagtgtcacttagaaggagaagaaatgtttgtctacccttgaaaataggacacactgttagtctttaaataaatttcaaatggtcttcttagaagtggcagagcatgatacaccacatcaacaggaactgactcttaggacttgactggatttataagatttagaaaaagattattaaaccaactaagtga

SEQ ID NO: 7475 - DNA, 419 bp, Homo sapiens
gcagttagattagctacttctaaggtgcttctactttttcaggatgttgtttctgtagcagagtcatctgtttcttgtccctccgccctctctatgttaatgattgatgaatgcctgaagtatatggagttgcagtggcaattactggggtttcagtggtgaacataaccagtccaggttccattgcccttgcccctgtcctcagagctccatctctccttagcagtattctctcttcatccctgatgggctgtataatctaaccatcaaatcccttctctaagccaccatcataggactcagtgctcctgtgtaggagatacatgctagtggcctagaactggggtggtccttgcttctgctaccaagggtgaggtaataaatgttttcctagcctcactcccttcaaactggtgtac

SEQ ID NO: 7476 - DNA, 769 bp, Homo sapiens
agcatcgctgccaccctcagggattcctcttgcatatctctgtgttctgtcctccacacacccatctctttagtcatctattgattttattcaattttcctggcagtttccccagtgtattttacctgaaaggtatgagaggaaaaaggaaaagcacaactcaaaatggttgactattccattctttgttttcttcaaaaagtgtaaagtccataaagatgccatagaaccactaaattcattgtcctttgtcacctctcagccaataatagtcattgatatactctccataccacaaatttaaagttttttgtgaactgtacatgcaatagccaagtttattttaactttagtcattactggatcccagagattttctttctcttttttggcatatagattatttatgtcacttcagtatgcccagtccacagatgagatcttctgagggactgcttctggagccggccctcttgtgtgattgaattagtcagtgatggttctcaggactagattagattgttactcttaaaataattacttaaaaaaaaaaaaaaaaaacttccataacttgaaaattttgtggccaggtgtggtggctcatgcctgtaatcccagcactttgggaagccgaggtgggcggatcgcttgaggtcaggagttcaagagcagcctggccaacatggtgaaaccctgtctctactaaaaatacaaaaattagccgggcatggtggcgcacgcctgtaatttcagctactcaggaggctga

SEQ ID NO: 7477 - DNA, 718 bp, Homo sapiens
agcatcgctgccaccctcagggattcctcttgcatatctctgtgttctgtcctccacacacccatctctttagtcatctattgattttattcaattttcctggcagtttccccagtgtattttacctgaaaggtatgagaggaaaaaggaaaagcacaactcaaaatggttgactattccattctttgttttcttcaaaaagtgtaaagtccataaagatgccatagaaccactaaattcattgtcctttgtcacctctcagccaataatagtcattgatatactctccataccacaaatttaaagttttttgtgaactgtacatgcaatagccaagtttattttaactttagtcattactggatcccagagattttctttctcttttttggcatatagattatttatgtcacttcagtatgcccagtccacagatgagatcttctgagggactgcttctggagccggccctcttgtgtgattgaattagtcagtgatggttctcaggactagattagattgttactcttaaaataattacttaaaaaaaaaaaaaaaaaacaatataaacaaacaaaaaagaattttactaattttaaacactgacttcctgtgaaaattgccagatctttacaggcgttttgtaaaagttagacctgtggggagttttgtttacactaattacaaagtttttacaaattgaattacaagttgaaat

SEQ ID NO: 7478 - DNA, 412 bp, Homo sapiens
  misc_feature (356)..(356): n is a, c, g, or t
  misc_feature (397)..(397): n is a, c, g, or t
  misc_feature (408)..(408): n is a, c, g, or t
acaaaaaaggagctttttgacgtaatcaagcctctatcaatcacttcttgcttcctaataacttttgtatcttcctttcaggagagcagttgaagtgaattcttctgggaccaaatccagtgtttctgccttgaagaaacataattaactgacattttaaaagccactttatagacctgttctgactctggtctaaggacattacttgatttatagtttatgaaaagtctacttttaggaatttggggtatgttttatgggtaggctcttttagttgattgctttcatttttctttggggaaattatctaggaatagctgtaggtggatgtccatcagaagcttgactttttaccnctgtggtacttggaggggctgactgacggcacagggggaanatttccacccnggat

SEQ ID NO: 7479 - DNA, 476 bp, Homo sapiens
gagtctttttcattagcagcctagtaagaaataaagcagtatttctcttgttttgtctttaattatctccattgagggttaacagcgttgggctttgccctttttgttcatgtggttgggtttcagtcaacactggcctgtcgtgttgttttctacagagaatacagagaactggttttggttatatcatattagggagttaaaaagatgtcctatatatatccaatcacaaaacgagcacccaaatcagctttagtggattcaggagatgtagtcaatcttccccacatgctttctaactcacttcaaatatgacagatttgtagctaactttcacagcaacaggaagttcacttagcactcagcgatgtgagatttgagagtcatctatattggcactgtaaattccatttcttagaaaaattacaaatgtcaatccttcttttataaatgcaaattctttccattagaagatg

SEQ ID NO: 7480 - DNA, 384 bp, Homo sapiens
tccactgggaaagggtggactttcccagtccactgactcaaatgtaatctcctttggcaacaccctcacagacacacccaaaaataatactttgtatccttcaatccaatcaagttgacactcagtattaaccatcacagaggccagggcagaatgattgcttgaacccaggagtttgagaccaaccttggcaacacagggcgatcccatccctacaaaaaaaaaaagtttaaaaatcagccaggataattagccattttctgtggtcccagatacttggaaggttaaggtggaaaggtcacttaagcctgggaagttgaagctgcattgagctgtgatctgtcgttgcactctagcctgggcaacacagcaagaccctgtctc

SEQ ID NO: 7481 - DNA, 528 bp, Homo sapiens
atagttttttttctaagcccatagtaatatttcaatcactatttttcataactattcatagctttaagtacattcactgtttttaaaatcgcatgtattcttgactgatggtttaacatcataaagcgtgagattatttttttcttctgatgtttggtttttctgtattttttggtttgctttaccggttggtaaaacagatacataagggttttttaatagaaaaaaagcattaaagagaaaatatgcccttaaaacaagcattttaaaaaaaaaaacctttttaggattagcagtttttctatttatatccaagtcagaagtagcagatggaactctttctaataacctgataatttttccatatcctacaggcattactttctctctaaacttgaatgataaccacatgaaaaacagcgcccaatttcaggcccatttcattggaatgctgaagctgagtccattgacatatatcaaggacacatttctcaggtctttcatgtacatgatcttatttattccacc

SEQ ID NO: 7482 - DNA, 268 bp, Homo sapiens
gatgcaggttgaaactcttcacatgtggatgttcaagaaatgcatgatgaatcatcattagattgtgcttgctagaattactgtatatcacatatagagctgtagtaatgcatttttgctattgcacaggtaggtgtaaggcaggtatagggatctgacctgcttggtgctgctcttcccagggaacatttggttttcctgagtttgctattcctgggagcaatattaagaggacatttaggttaacttggtttacaacagtgactat

SEQ ID NO: 7483 - DNA, 420 bp, Homo sapiens
tatttagttctaggtgaaggggtgggtaacactttacctaaatttcccaaactgctccttgtcctaattaatgacctcatctgagaaggtaaggagaaagtaagctactcttcgcgtctgttctgattagtttaggctgagctgaaggtagtgttcgctattgtgcctcatgaacttcaggtgcgacatacctggtggctgtctagtatttcagccttccaaattctccagtcttgcaccagctgagtgaacggaagagaaaatggccacataagagttttgcaggccgggcgcagtggctcgcgcctgtaatcccagccttttgggaggctgaggcgggcagaccacctgaggttaggagttggagaccagcctggctaacgtggcaaaaccctgtatctactaaacatacaaaaaaaa

SEQ ID NO: 7484 - DNA, 341 bp, Homo sapiens
gtcactacctgactcctaaaactcaccttctgtggtgaggaggagtggtggttggcaccagggctctttccttttgtgtaactaacagaaagctgttaatctttcttgttttttttttcactttcctggaaaattgatacttcattaaagctttctagatgccacttattctacccaagaccaccttctgctgcttatttttagatgactacagattcttcattcactatggaagcttcacaaatcactttgtcagacaaattgtttgaccttccactggagagcagttgttaccactttctaataatggcccataaacatattttttaaaaccacccgga

SEQ ID NO: 7485 - DNA, 486 bp, Homo sapiens
cctgggacgttctgaggaatagttggagcaggggacatggcctgtgcagtcttcagccctgactcacccactccaagaatctcaaagaatgtaaactggcttagggaggggcagcagagccagtctcaaataatatgggcactgtttaccttttcttgcttctaaaatctatctgctcttatttttgaggtttgggtgagagctattctaggcagtggacaaatataaagctgtttttagaaacaggtatttccagtactttagcgaaaatactggggctttgttttcactgcttcgtgtatccttaaatgcgtttttgtttttgtttttttaaccatatggagccactgtggattgaaattacctaacttaaaaaaatctgataagtttaaaataaggatactgaggcattcattctttttctgtcatctaagaacaatcagccacgtaaacgtattaaaatacacggaaagagtgtgtgaaagc

SEQ ID NO: 7486 - DNA, 556 bp, Homo sapiens
ctaaaataccaaaatttgacaagttatcataatcagtctcttaaaaatgcaaatgtctttcagagaattaatgaagacatcagtcattcatatgtaagtgtgaagtagtatagtggctacttttatgtattgctgaccttatatgaaataaagtgagtgagtctataatttcctttaccataagaacactttgctaaaaatactagctttcaaaatatagtgccttactccaacttctatttctctcaacaaatcttctttgatatttcttctttactatgatagaagtctggaaagactcctacttttcatttgttaaattttattcacttctaattccctttaaagcttgtttttttcttttttcaaaaagttatgaccaattatgtgggaagaaacaataactagtaacatacataccaaagttgtccatctcaatatataacaagggaataaaaaatagttacatgctcttcctcttccccatcccctttcctactaagtgttagaatctcataaagccacatgttcttatatacagtatgttaatatacta

SEQ ID NO: 7487 - DNA, 504 bp, Homo sapiens
acttgtttcctgtgtagatagttctttaaggaatcagactgtcagttgtactttaaaacaagaacaataacaacatagaagtaactgttgataaatccagcaagtagtatatctgtgatatatttctttttcctcgtaactacgaaataacatacatgtagttattttttctaagttgttaaagatctatctttgaatcattgatgttaataacattttctcatggcacagattactgtggtgttaattctactattaagttacagtaatttgaactggattaataattctttgttcagtctcattttgcatgacaaaacccccttcgttatatgtgcttgtggtgtatttaagcaagaagtacaaaaagtgcctgggtgagttccagcctggccagtgacatcattttggagatgttttgtcagagaaaatgatgactaaataaatacatggaacctatgggtaaatgtctcattgttgcagattaaaatttgagccatagat

SEQ ID NO: 7488 - DNA, 290 bp, Homo sapiens
agcttataggtctcctgttgcagtggaagaagtcgtctcctctggaaattcaaaaccttaggcctgtctatacttactttgggtacatttacattacgttatagtttgagaatcaccaaggtgaaattttaacattaaaactaaccccaaggcacctggtagaagcagcacagaataaatttctgcttacattctcaattgagacctaacagtgctcccactgaaagagtccaactaaacttgaacccctgtgctgactttgcaaaatgagaccctcaatggctttagat

SEQ ID NO: 7489 - DNA, 456 bp, Homo sapiens
acctactcttcatctttccctcctctgctgaaaataaattttcctctagatgtcctatattacttcaaaacaacacagccctgatgatcacatctatacaaatccacaaatatccttcactcccaaaacatgtcttttcttcactgacatgaactttttcaaaaactctttccttttttgagggaagggggaatttttgcttgttttgctttgctttctgaatgggaggtaggaaactattagaagggggaaggaagaagagaaaccaaagaagtattgagtagagtcaagaaatcagtgctgtctcaatcttgacgattcttgtccttagagaaattgttactgtttaaatggcttttattgtttaacctataaaaaacacccctctgccccaatttttttccttcaagtctcttaacatgtttctcttcacttcccaatgtggggtattttgct

SEQ ID NO: 7490 - DNA, 249 bp, Homo sapiens
ttcaatatggtgggtggactgcaggaggaaccttctgaaagaggtgatggccaggaatgaaatgataagcaggtgctatctgaagaggagacacttcaagcaggaagtttcgatttttttttttaaagagggttgtcatagcagcatcattcatgatagctaaaatgtggaatcaatataagcgtccactgacagatgaatggattagcaatatattgtttatcccattgatggaatgaaattcagctt

SEQ ID NO: 7491 - DNA, 536 bp, Homo sapiens
caactccatcttattttactaagcagttattaattaattttagcaatacatcttcatctttattgtacttctatctttgttaaatgagaaaaccaaggcatcaaataattgagtagacaaagatcatattcacaagttagtaaaaagccagaattagaatgcaggttttttttttcaaagtccagttccatctacattctaccagactgcatatcctattcctgtatctattaggtattcccgaactgaggattagtgtttttaagtacagtctataaatctgttcaaagaatagttagaacattgaatgtagagttaaggctttgcagcagccaattgcaaaaataaggaatccagtcttttgaaaagaaacactactgcttgttctcataccttttataaatgtattttaaaaagaatgaactaattaataaaacatatcaaaggcttttaaggcttgttttgagcctgccttattgtggaaattgcatgcacctggtttggcaaataaattccaaaacctttatacatttgta

SEQ ID NO: 7492 - DNA, 425 bp, Homo sapiens
cctgaccttgcgacccacctgccttggcctcccaaagtgctgggattacaggcgtgagccacccgcgcctggcctgctatttaattttcatatatttgtgagttttttcaattttctttctgttattgatgtttaatttctttccattatagacagagaacatattttggattatttcttttttctttttcttttttttttttttttttttttttttgtgagacggagtctcactccctctccaggccaaagtgcagtggcgtgatctcggctcactgcaacctctgcctcctgggttcaagtgattctcctgcctcagcctcctgagtacaggatgctgggactacaggcatgcaccaccatgcccagctaatttttgtatttttagtagagacagggtttcaccatgttggccaggatgatct

SEQ ID NO: 7493 - DNA, 307 bp, Homo sapiens
gcttgcttagtgctagtttgagtccttcagtggcaggacagcctgtaaagtaccacaagtatgggagtgttataatggcagagtgaaacgattagagcagggaggaagtgaattgtgccattagtaccttcatgcaaattataccatgtgattttggacagtgaatgatttttgcatcattcattcacagcccatcactctgttaaggtgagagtgtaattcttacttctcccatcaccacctgtagctagaaacaggaaagggagaatgagatgatccagacaacataaaaaagatgcatgtaagc

SEQ ID NO: 7494 - DNA, 696 bp, Homo sapiens
tgcccctttatcactgctgagggtggaactgggtgtgggggggcatcttggtatgatttggatatagtctgcactgacttgaaacacaggcatttcatttgccccaggttactggccttttttcatttcatagaaggcaaagagaattggccgggtgcggtggctcaagcctgtaatcccagcacttggggaggccgaggcgagcggatcacgaggtcaggagattgagaccatcctggctaacacgatgaaaccccgtctctactaaaaatacaaaaaattagccaggcatggtggcaggtgcctgtagtcccagctgaggcaggagaatggtgtgaacccgggaggcggagcttgcggtgagccgagatcgtgccactgcactccagcctgggtgacagagcgagactccgtctcaaaaaaaaaaaaaaacaaaaaaaaacaaaaacaaaaaaaccccgcaaagataattgatagcatttgcgggtgtggcaaaggtgttagtacctcctctcctctgttaaagtgctattggagactttcattcagccatatttggcctcctggttacagtactgccctgagggctttgcagtgttagcctgatgtctggagaacctgccccatgtgccactgttttcatattcaggctcatgaagatgatcactcacttaagggttcctatttccttaacct

SEQ ID NO: 7495 - DNA, 263 bp, Homo sapiens
aaagctaaagaagaccaggggaccaagctggaaatcaggctctgcaatcagattccagagggaatgccattccacccaatcacctagccacaacggttcccttccttcaagatgctgcatgcctcttcaggcgaatggattaccttgtaagagtgacctgaaaaagcgttagcccagccacaccgaggcttaactgagccatttgattctcactgcctctctctgttgcttcctcttgctttcaactacagggtctttctgtt

SEQ ID NO: 7496 - DNA, 1696 bp, Homo sapiens
gcaccaagcacccactgtgcaccaggcactaagtctctagcctctttctcccttctgctcccatccaagaaagacagtgtataaggaacatctctgtaattgtgtcccctctcatctatgctctttcctgtcttccttgaccaaagctctctttgaggtccaaaaaaggctgccctgggccatatgtgctatggagaggactctcccaaacccccaatagctagtgacagccacttggcctcactaccagaagaagggtggagtcagaaaccaaagtgacctccagagctgtcctcctggcacctgagtgtccttgctctagaggttcaaaggcagcaaggcagtgagctatgagcccagcatggatgtgtctcaggcacctcatccccaccccacctcaccccaacaaactcctctagaagaagccaagaatttctctctatgtctgtttcactttttggattgcatctccccaaaaactaaatgtgaaatccctaccatttctagcctctattgcccagattggagtcagaggtcaaaaaaggattccaagtgatggaactccaggggtggagggaaattggcagttcctggcatctcttgtgtaccagctgctgtgctgggtgccttgcatgcacgggcttatctgatcttcctcaaacttcagataggttagggaaggacaaaggcccccagccatgaagggttttgctatttccaaagcttccccttatcgtcccctgtgattatctcccaaccccgtgacaaaggtagagcaaatattgttcttcccattttacagattcagaaaccaaggctaagggactggtctaaagtctcacaggtagtatatggtggagccaacacttgaactcagacctttttacacaaaatcccatgatttttccactgagacaaatcctaggctcctgggaggccctggcagaagccagaacacatggctgggcctttccagcccaacccactgtcttgcagtggacggagagccttggcgagggcagcagggtagagaggacaaagaatgtggggctggtttctgccctttaagagcacccggtcagtcagagaacagagatcacacacaccaaaccagacagaggcagggcagcatggagacaggtagacagacctccaggtccctaagctggggacagagaaggttctgagctgtcccatactcccactttgtgccaaatgactttgcacctgcaaatggtgcttcaatgtcgttttgtatctttaagctgtgatgttgtatatatacaatgcctcccagctagactgtaagccctttggggacaagggctgcttccagttcttggatggcgttctcctatctaccttccttcaactgctctgcatataataagcactcaataaatggctcatttgccaataagtactgtttcttccacaacttggcagtggtaatagaaatacagcccaaggtaccagaagacaggcggagctccctaccacttctaccccagccctcaacttctcccagggaactcagaagtccccatatcaggagaggaggggaagggctctccctaagacattcaaattccccctgccacaaatggggagacccatcactcagctcacaaaggtcccgggcattcctctggagctgccagggcagggcctgagtgcttgggcaaagagaattccg

SEQ ID NO: 7497 - DNA, 393 bp, Homo sapiens
gtagggaaaaatgtagatgattccttagctttgtaataagcaaaactaaatactaattaggatttatattctaaagaatggagtgagaaaatagatgtaatagtactgtaatttttttctttaaaaattactactctaaatgaaaacatatgactttgaaccattatttttctttttctttttcttttttttttaaacggagtcttactctgtcgcccaggctggagtacagtggcatgatcttggctccctgcagcctctgcctcccagtttcaagtgattctcctgcctcagcctcccgagtaactgggattacaggcgtccaccaccatgctcgactaatttttgtatttttggtagagacagggtttcaccatgttggccaggctggtg

SEQ ID NO: 7498 - DNA, 466 bp, Homo sapiens
tacttgtaagtaaattaaatcattctctactcctgtatgcctgccaaccaaatgggaaatcgctatagaaaagatggtttaaattttagtctttgaagtggtttacgcacgtttctggaatcaagatttaatgcagacttggattggatattgaatattttttatttgtctacttttctctccatagggagtttatagcttcattgcactgtgtgtggcatttgggtcctgtttggcagcaatgactgcctttctgtttagtgtctgtgtgctatgaagagtgcacacaggggtccagatgcatcctgttttgagaatgttaatggatacaccagctgctgctttggatttcacccattggtggtagttgacccgctgtttgtttggaatgcagacaatttaagtgaagacatatccatatatgtggctctgttacagtggtgaaatctacaaccataagaaggta

SEQ ID NO: 7499 - DNA, 405 bp, Homo sapiens
acactgagacctttcacatctcactctcacttcttggaatggctctctacctcgtctgcctgctgagcaacctcttggggagacgcgggcactcttgagtcactgaacttgagctatttggtgttgggagtttatagcttcattgcactgtgtgtggcatttgggtcctgtttggcagcaatgactgcctttctgtttagtgtctgtgtgctatgaagagtgcacacaggggtccagatgcatcctgttttgagaatgttaatggatacaccagctgctgctttggatttcacccattggtggtagttgacccgctgtttgtttggaatgcagacaatttaagtgaagacatatccatatatgtggctctgttacagtggtgaaatctacaaccataagaaggta

SEQ ID NO: 7500 - DNA, 398 bp, Homo sapiens
ccacagcgcccggccgaactctggtaacttattacctagtgggctcaaaaggaggtggaatttatattgtttaagtttcatatatttccttatccctttgcatatagacgctggagaggggaaagagaacggtagagatgtcccaagattggggactgattcaagagcatgttataagatcagaagaatcagaaagttgactgagagtcagtttttttatttgtaaaatgggaataaataatacctaattcttgaagttgttatgagacttgaatgaggaaagtaaagtgcctcccagataacatagttggtgctgtaacgaaggcaggaaccacagaaggaatcacactagccaagaaatgatgatgatacagtgaaatgagtgctgtaaaagaacc

SEQ ID NO: 7501 - DNA, 421 bp, Homo sapiens
  misc_feature (36)..(36): n is a, c, g, or t
ggaaaacaaaatcaagttgagtgtgagttagatttncccaaaacccacacagcattgtgcctacaacccagtccttgttctccgtgagtctagtacatgtccaactacatgaagatcaatatccctgctcccttccagtttataattcaatcatcggaattgcagtaaaaattatgaacagaggctgggtgcagtggagagtaaggggaaatgacaacagagggagcatggggagaggatggaagaaacagacacaaggggaatgagcagagggaagacaacaaatcacagcagaagggaagggatgagaagcaggagccttcagaggtcacaggtctactactggatcacctgataattaattggaaggtttatgtatacatttaaaacatcatgttccatttctaacattattcataag

SEQ ID NO: 7502 - DNA, 242 bp, Homo sapiens
ctggggtgattagaggatcccctttccagagtagcttccagagggagcatggggagaggatggaagaaacagacacaaggggaatgagcagagggaagacaacaaatcacagcagaagggaagggatgagaagcaggagccttcagaggtcacaggtctactactggatcacctgataattaattggaaggtttatgtatacatttaaaacatcatgttccatttctaacattattcataag

SEQ ID NO: 7503 - DNA, 1856 bp, Homo sapiens
cagcagagtccagtcggactgtcatcctttctgcgactctggcgctggtcccgagcagctcacgggcccgtgtgcttccgggtctgagattggcatggtggaccaggtggagggtgtggcctctactaggaggcaaattcgtaaagacctcggcttgggactccgggaactcgggccccagatccttgttcgagctggtcttcagtttccccatctgtacgctgaagagcctggggtccagtaacccccatcatcacccagtttacagaagaggaaactgaggcccagacggggagcagctgacaccaagtcgttaagagaatcagcgaaggggctgggaatccaggacctgcgccttttacccaccgcggcgccggtctcacgtgcagtcccttcgctcttctcccctagttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgctgcctctgggacctgactctgtctcctgtgtctcttatcaccccccacccccgctcccatcttggtgtcacccatgggggctaatccggtccccttggataatgctttatattggatatagttcaacccctactgcggagaccagggccccactatccttagatctggttcctctcccgatcctgaccctgccgcctggttctgagccttcccctggggcttggctccagcctttgttacatagttgctccttaatctgtttccaccctgggggctcaccaattttttttttttttttttttttttggagacagggtgtttatctgtcacccaggctagagtgcagtggcgggattactgctcactgcaacctcgacctcctgggctcaagtgatcctcccagctactcgggtgggctgaggcacgagaatcggctggacccaggaggtgggaggttcgcagtgagccggggattggcaccaatggggcatctccaggcgcgggggggtgggcaagagggggaagaatctccctttttctcaaaaagaagaacaaacagcatgaaacaaggcaccacagaggacggcagtcacaagcgagcgtcaactataaacagagcgtagcgcaggggagaataatcttctgccgcgcgccagaaaaggaggaatgaccgactaaggacgcgcgacgtctaatgaggtcaccacacaacacttctgtcatccaaaagatgtaaatgagcgtccacataggggattatatgtacaccgggcaccgac

SEQ ID NO: 7504 - DNA, 2924 bp, Homo sapiens
cagcagagtccagtcggactgtcatcctttctgcgactctggcgctggtcccgagcagctcacgggcccgtgtgcttccgggtctgagattggcatggtggaccaggtggagggtgtggcctctactaggaggcaaattcgtaaagacctcggcttgggactccgggaactcgggccccagatccttgttcgagctggtcttcagtttccccatctgtacgctgaagagcctggggtccagtaacccccatcatcacccagtttacagaagaggaaactgaggcccagacggggagcagctgacaccaagtcgttaagagaatcagcgaaggggctgggaatccaggacctgcgccttttacccaccgcggcgccggtctcacgtgcagtcccttcgctcttctcccctagttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgctgcctctgggacctgactctgtctcctgtgtctcttatcaccccccacccccgctcccatcttggtgtcacccatgggggctaatccggtccccttggataatgctttatattggatatagttcaacccctactgcggagaccagggccccactatccttagatctggttcctctcccgatcctgaccctgccgcctggttctgagccttcccctggggcttggctccagcctttgttacatagttgctccttaatctgtttccaccctgggggctcaccaattttttttttttttttttttttttggagacagggtgtttatctgtcacccaggctagagtgcagtggcgggattactgctcactgcaacctcgacctcctgggctcaagtgatcctcccagctcagccttcaagagtagctgggactgcagacctgcaccaccacgtccagctgcccggttaatttttttctgtcggtttgaagaggggagaaggtctcactatgttgcccaggcttgtctcaaactcccgggctcaagcaatcctcccactgtggcgtcccaaagtgctggggttacaggtgtgagccaccacacactgggctctgctctgcctttctgagtttggtttctgcttatggtggggagcttgttcccgttcttcccacaagaacccaggatgtggcacagcttccctgccgtcttccttcactcagttggctacgcctcccatcctagctccacttccagaactgccttcaccctaggctgggtccttgttttgtttttagagacagggtctcactgtgtctcccaggctggagtacagtggcgtgatctcggctcactgccacctccacctcccgagttcaagcgattctcctgcctcagcctcccgagtagctaggattacaggcatgcaccaccacgcctggctactttttatatttttagtagagatgaggtttcaccttgttggccaggctggtctcgaactcctggcctcaggtgatccacccgcctcacctcctaaaatgctgggattacaggcgtgggccactgcgcctagccagctgggtccttgttctgctgcccaagcttggccctggttccgtgtgctggttctactttttgttctcccatctgcctcctgcctcctcccctttgagcttagccccgccctctcagcctgatttctgtttcccaagtccagcagtgtcgtgggataggttttgctttcttttactgtctccatcctacttacacctccctgatcctggggtctggggactccccatggtttccttccttctgcaggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcccagtcctggtgctttcagcgccagatgacagcactttgcagataagaacgatatgatgtgtggatttcactacatttggctcctggatgctataaaaggacttggatttctgacttggctcagggactggggttagcagtctctttctgctccttttcacctgtgttttcttccgatcccagctctggtccctcagccgcattcatatttactctcctctcccagcctgatatccctgtccctcatctcaacccgaagccaagatctgagcccccaagatggagaatggggaggagctttttatggcggactgattaaaactcttaagcattta

SEQ ID NO: 7505 - DNA, 3694 bp, Homo sapiens
cagcagagtccagtcggactgtcatcctttctgcgactctggcgctggtcccgagcagctcacgggcccgtgtgcttccgggtctgagattggcatggtggaccaggtggagggtgtggcctctactaggaggcaaattcgtaaagacctcggcttgggactccgggaactcgggccccagatccttgttcgagctggtcttcagtttccccatctgtacgctgaagagcctggggtccagtaacccccatcatcacccagtttacagaagaggaaactgaggcccagacggggagcagctgacaccaagtcgttaagagaatcagcgaaggggctgggaatccaggacctgcgccttttacccaccgcggcgccggtctcacgtgcagtcccttcgctcttctcccctagttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgctgcctctgggacctgactctgtctcctgtgtctcttatcaccccccacccccgctcccatcttggtgtcacccatgggggctaatccggtccccttggataatgctttatattggatatagttcaacccctactgcggagaccagggccccactatccttagatctggttcctctcccgatcctgaccctgccgcctggttctgagccttcccctggggcttggctccagcctttgttacatagttgctccttaatctgtttccaccctgggggctcaccaattttttttttttttttttttttttggagacagggtgtttatctgtcacccaggctagagtgcagtggcgggattactgctcactgcaacctcgacctcctgggctcaagtgatcctcccagctcagccttcaagagtagctgggactgcagacctgcaccaccacgtccagctgcccggttaatttttttctgtcggtttgaagaggggagaaggtctcactatgttgcccaggcttgtctcaaactcccgggctcaagcaatcctcccactgtggcgtcccaaagtgctggggttacaggtgtgagccaccacacactgggctctgctctgcctttctgagtttggtttctgcttatggtggggagcttgttcccgttcttcccacaagaacccaggatgtggcacagcttccctgccgtcttccttcactcagttggctacgcctcccatcctagctccacttccagaactgccttcaccctaggctgggtccttgttttgtttttagagacagggtctcactgtgtctcccaggctggagtacagtggcgtgatctcggctcactgccacctccacctcccgagttcaagcgattctcctgcctcagcctcccgagtagctaggattacaggcatgcaccaccacgcctggctactttttatatttttagtagagatgaggtttcaccttgttggccaggctggtctcgaactcctggcctcaggtgatccacccgcctcacctcctaaaatgctgggattacaggcgtgggccactgcgcctagccagctgggtccttgttctgctgcccaagcttggccctggttccgtgtgctggttctactttttgttctcccatctgcctcctgcctcctcccctttgagcttagccccgccctctcagcctgatttctgtttcccaagtccagcagtgtcgtgggataggttttgctttcttttactgtctccatcctacttacacctccctgatcctggggtctggggactccccatggtttccttccttctgcaggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcccagtcctggtgctttcagcgccagatgacagcactttgcagataagaacgatatgatgtgtggatttcactacatttggctcctggatgctataaaaggacttggatttctgacttggctcagggactggggttagcagtctctttctgctccttttcacctgtgttttcttccgatcccagctctggtccctcagccgcattcatatttactctcctctcccagcctgatatccctgtccctcatctcaacccgaagccaagatctgagcccccaagatggagaatggggaggagctttttatggcggactgattaaaactcttaagcatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaacaggggggggggaaaaaaaaccggggggccaacaccaacctgaacactaccacgacgtttatgtgtacaacaaggggggcccccatactattatggtacgatatctaaaaacagcagcggcggtgagaacacttataaaaacaacgtcgaaaggcgtgaaaaaacggcacctcgggagaaagcatagaagaaaagaaacacacactttttgtgagggggtggtaacaacatgtgacacaaacagcatcaagagatatagacgccacgagaacaaaaagaaaaccaaggacgaacagtaggggaaacacacccggccgaactagttaggacgagcggggcgaagcggtggcccgacgcagaacatatcttacagaaaattctcgcgggacggtcgtgtgaccatcatgtaccggaagacgcagaggagcaacaggaacgcaaaagcggacggcgagcgagacaccgtaccgacacaacagacggtggccagcaggctgagacgacaggcagccagcacgccaagcaagacaacaacgacaaacggaaagggaaccacaaccgtgagaggacaccgaacaagagcacacagcacatagacacggcgtgagcaagacacaaacagcacgactcacacagagaaagcaaccatgccgaggagaggaccgcagcaacgacag

SEQ ID NO: 7506 - DNA, 1595 bp, Homo sapiens
cagcagagtccagtcggactgtcatcctttctgcgactctggcgctggtcccgagcagctcacgggcccgtgtgcttccgggtctgagattggcatggtggaccaggtggagggtgtggcctctactaggaggcaaattcgtaaagacctcggcttgggactccgggaactcgggccccagatccttgttcgagctggtcttcagtttccccatctgtacgctgaagagcctggggtccagtaacccccatcatcacccagtttacagaagaggaaactgaggcccagacggggagcagctgacaccaagtcgttaagagaatcagcgaaggggctgggaatccaggacctgcgccttttacccaccgcggcgccggtctcacgtgcagtcccttcgctcttctcccctagttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcccagtcctggtgctttcagcgccagatgacagcactttgcagataagaacgatatgatgtgtggatttcactacatttggctcctggatgctataaaaggacttggatttctgacttggctcagggactggggttagcagtctctttctgctccttttcacctgtgttttcttccgatcccagctctggtccctcagccgcattcatatttactctcctctcccagcctgatatccctgtccctcatctcaacccgaagccaagatctgagcccccaagatggagaatggggaggagctttttatggcggactgattaaaactcttaagcattta

SEQ ID NO: 7507 - DNA, 415 bp, Homo sapiens
gtaaaaacccttttaactcctatgaaaaatgaaatgctgagagcactatgaatgacgacagctgtccataagtatcagagagagttctattgtccagcttgtccctggataaaatgaatactttacagcagaggctgttcagcttggctaaagagtgtggggagaaggggaggaggtcactggagatttcgcacactaatttaatctgggaaaaggacaggctctgcatctcccttgaacagactggcagcaatctgggcccccacagaactatctccttttgcctgtgctctatttattccttatctctgtttaccaaccgctaggtccctttcattcacaccacgaggccgttttcctactatcagtcagcagctgacactgtggaagagcctcaaaggcaaaaaaaaaaaaa

SEQ ID NO: 7508 - DNA, 382 bp, Homo sapiens
agtcaggagttcaagaccaagctggccaacatggaaaaaccccgtctctactaaaaatatgaaaattagctgggagtggtgggagatgcctgtaatcccagctctttgggagcctgaggcaggagaattgcttgaacctgggaggcggagattgcagccaagattatgccactgtactccagccagggtgacagagcaagactccgtctccccaccgccaaaaagaaacgtatatcaataaaatgaagagtatttggtttagtaacacctaagatttttctgtgtagggagatatatcttgaaattaatcttgtagtttacttaatttcaggagattataaggatatggctgtattccccagacccacttagttttgctcaa

SEQ ID NO: 7509 - DNA, 453 bp, Homo sapiens
tcttagataattgccaattttgaaaagttggcattttgcgtcttttgatcaatatagccattttcatatagaagcagtcctacctattgccatttcaggtggaaagccttaccacacaaattgatactgtgtcctcaccaagtttaaaagatctggccgggagccgcagctcacgcctgtaataccagcactttgggaggccgaggcgggtggatcatgaggtcaggagatcgaaaccacgtgttaggaggctaacacagtgaaaccctgtctctactaaaaatacaaaagcaattagccgggcgtggtggcgggctcctgtagtcccagctacttgggaggctgaggcaggagaatggcgtgaacccgggaggcggagcttgcagtgagccgagattgcgccaccgcactccagcctgggcgacagagcgagactccgtctcaaaaaaaaaa

SEQ ID NO: 7510 - DNA, 852 bp, Homo sapiens
aagagacccactgcggaagaaacttgtatcaccaataaaatgtgcatctgacttttggacagggatagattcctcagctcagcttctactttgctatgagtatctcgaaaagcaaatcgtcctacagattgtaaaaggttgctaatcagtgaaatacgttacagggaattttcacattgattatgaatggaaattattttgtgtctgagagaatatgtacaattttaccttgtctgataaggtgaattataaaatgttttacataagaaataaaccaatttcattataagtaacattttaaaccattcttagtacttactaatttgtgttcttcttacagatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7511 - DNA, 644 bp, Homo sapiens
  misc_feature (15)..(15): n is a, c, g, or t
  misc_feature (17)..(17): n is a, c, g, or t
  misc_feature (27)..(27): n is a, c, g, or t
  misc_feature (31)..(31): n is a, c, g, or t
  misc_feature (51)..(51): n is a, c, g, or t
  misc_feature (54)..(54): n is a, c, g, or t
gtgccaattttattngntatcaccaantttnaaacccacgtgggtgttaanaanaaagcaggtacgtcgatccggatgaagtaagagtttcatgtctactacaatacagatgcagatgagttattcacagggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7512 - DNA, 491 bp, Homo sapiens
tactactaaattcgcggccgcgtcgacttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7513 - DNA, 338 bp, Homo sapiens
cttcaatttgttaacagagcaaatttaagactttcaatcaaatatgtaacatgctgaaatgaagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7514 - DNA, 2101 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7515 - DNA, 2054 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggactaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7516 - DNA, 2138 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaaaaaaaaaacacaccaccacacacccccaaaaaagggg

SEQ ID NO: 7517 - DNA, 2205 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaatattttttctaattgatttgcttgggaaataaataccatcccctacctgcccactccatcctccttgctgaaaaagaaaatagtcttttaaaatcctaaaaatt

SEQ ID NO: 7518 - DNA, 1814 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgctcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7519 - DNA, 2047 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7520 - DNA, 816 bp, Homo sapiens
cgtctttcaactgcagtttgcgtctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7521 - DNA, 2030 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7522 - DNA, 2043 bp, Homo sapiens
  misc_feature (1499)..(1499): n is a, c, g, or t
  misc_feature (1513)..(1514): n is a, c, g, or t
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagantttacaatgaatgnnttatttcaacaatggagatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaa

SEQ ID NO: 7523 - DNA, 1659 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaagttttcctgggtattttcctgaatggggtggtgaagaagaaaagtaaaagaataaagggggcaaggatgaag

SEQ ID NO: 7524 - DNA, 1543 bp, Homo sapiens
tggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaaggtatcacactaattacacaatgaaattaatatgtttagaataactg

SEQ ID NO: 7525 - DNA, 339 bp, Homo sapiens
tctttttttgagatggagtcttgctctgtatccccagctggagtgcagtggcgtgatctcagctcactgcaacctctgcctcctgggtcccagttcaaggaattctcctgcctcagcctcctgaggtttcaccatgttggccaggctggtcttgaactcctgacctcatgatctgatctgcctgcctcggcctcccaaagtgctggaatcacaggcttgaaccacctcgcctggccaccatcatcttaagtcagaggctatcaccaattttggagcaaacagattttgtgttttcagatgtattgcaatagagcctacatgtcgggtgtgttctagaaa

SEQ ID NO: 7526 - DNA, 1041 bp, Homo sapiens
  misc_feature (227)..(227): n is a, c, g, or t
agggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagnggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcacc

SEQ ID NO: 7527 - DNA, 1632 bp, Homo sapiens
  misc_feature (227)..(227): n is a, c, g, or t
agggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagnggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaataaaaaaaatt

SEQ ID NO: 7528 - DNA, 2070 bp, Homo sapiens
  misc_feature (227)..(227): n is a, c, g, or t
agggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagnggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaagatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaataaaaaaaatt

SEQ ID NO: 7529 - DNA, 295 bp, Homo sapiens
acacaaacaagaatgtgagaacttgtctgctgtttacagaaatatgctttttttggggggaggggtaatcttttttcttttggtaaggagaagatagatattcaaagaaagaggcagataaactgggctcttctgaatcctgaattactttatggctcctgggccttggtgtctttgtaaccacagagttcatttcactctccaggaagaaacttgaccctctaataaaaccacatggagccttccagggcgacctcactgtttcatttatggagtggtcagattctgtatctag

SEQ ID NO: 7530 - DNA, 323 bp, Homo sapiens
ccactgtcatcacgctggagctctgttttccctaagtacggtatttgaaaggaattacgcaatatagtgtcttttcccagctgggagaggcaagtcactgcttagatggccggtcctggatatgaagaaatttggtctactcagtgtgagtgacatatttaccctcctccaccatgaatgtgcccatgcacttagccatttctgcagagttgcacagattctgtacttgctgaaaaatatgcttgcatggaaaggccttgtggcgtattttgtggcattgaattgctaccatctgtttcctagccaacgttaaaagaaaaaga

SEQ ID NO: 7531 - DNA, 419 bp, Homo sapiens
gcccaccacaaacttactttttaaagtattactgggcatgccagaaagtgggagaactcttcaagggacacagggagtggcaaatgggcaggagaggtgcgccatccctagcctggtcagcatgggtcacccccacagggaggagctgaacccgacattcctccaccatgcaggaaccaagaactgaagtcaccacatcatgtattttctaaaccagggcatttctgagagtgaaagggagctattaataatactgctggggaaacaggcttaagccaaacctatctgtagcaaagcaagatgtatggttgccctaaaaagtgttccaaggttaataaaaactgctagctcccaccagaaataaatgcaggttctttctgaaaagcattcccaataagttctacaaagtacagccagat

SEQ ID NO: 7532 - DNA, 609 bp, Homo sapiens
cctgtggagagcctggcatgaacagaggccttgcggagaactgaagccttcagtccaagagccagggaggaactgaattctgtcaagaaccacttgagtgaccttggaagcagatcctttcccattggagccttgagattaaagccaccttacctgacaacttgataggagccttatggggtctcgctatgtgcccaggctggcctcaaactcctgggctgaactcctcctccccaactcggcctcccgaagtgctgggattacaagcgtgagccaccgcgcccgcccacatctcttcttacaggtcaactggctttccttgacacccagttacttcgttcttcaggtgttgcaaaactcatcagcaagcacctaggcaattactgttcaaaatatctatgcagtctactagacttaagattcagaaaggcagaaaccacatataccttgttcacagctggacttctcagtgtctagtactaggattctcaatacatatctgttgaagttatgatgacattattaccatatagctatttgagttcctccgtaatcccaattctcaagttctttgagagaaaaaaataagtaaatctcaattatagaatt

SEQ ID NO: 7533 - DNA, 319 bp, Homo sapiens
gcttccacagccaaaacctgagtgcatgcggattctaaaaaggctccttctgccttgtcctaactagagctgtgttatttccccaagttgccctggtttgtatgagctgaaaagcccgtgactagcagtagatcacaggccatcctgcagaagctaggtgcctgcatggggtcaaaggtcaggagttactcacaattgttctggaacaatgtttcagatagtatacttccctaacttagagacaaacgagctgcattcagaatggctctagttcagaaagaaaagcctctcttgcactcaaatcaagatgagaaataac

SEQ ID NO: 7534 - DNA, 382 bp, Homo sapiens
tgcactccgtctgttcttcagagcatttacccaaatgtatgattgtgcatttctttactcatttatttgctctttttcccttcccgaagacgaggcatatgtctgtttcctcccttgttcccagagccaggcaaatacaaaatgacagatagctgtttgtgcagtaactgctgctgagccccctcaggagggaggcattgttattcttattcctagtaggagtagaagccgtcatcgttgtagtcatcacccgtgtcttataattgaggagacggaagcacagagtggataagggacttagttcagattgcacagccaggaagcactggaatggggattgaaacccaggactggcaggttctcaagacccctaccctcagct

SEQ ID NO: 7535 - DNA, 570 bp, Homo sapiens
agcagccccagcagcaatctgggtgttcaatctatctcgatctcacaatgcccatgcctcctagaggtcttcccagagcttaggagtctttgcccctcctgggaactttctgagggtccatatagtggtccttagcactattgctgtttttttttttttttaaattttagttgtaatatacgagtgttagcaatcctcatacatctctgacttatccacagtgcctagtatacaatggacaatttagtgaacaatgaataaatcagaatattgaggcttaggaaactaggacccatcacgaaccttctcatagtaatccagatcctggatggaagcttttaataaacacaacttctgttttccttcctctttgttttttatttcttctcgaaagagacttaattgaagaaaatgagctctttcacttcttccatcctccaggaacataaaactgacagcctcctccaaatgattatttagcatttaatgatttattccttgagcgcccagttgatcttccttgggcccatttgaagaactcttgtagcaaggggaaaattcacatgatca

SEQ ID NO: 7536 - DNA, 449 bp, Homo sapiens
  misc_feature (34)..(34): n is a, c, g, or t
  misc_feature (97)..(97): n is a, c, g, or t
cttgcgagtttcttctcattctccaactgccagnaaaaaaaagcatttgaaacaaattctcaaaaccgacaatactacactacaattggattgctgngaaatacattacagagacagattttacatgctataaatttttcaaacattgatgcgactttaagagtggctttattcctgaagtcagcgagaacacgaacccactggcaggtgttggtctactctttctccagtgataaaatatgaatatcaagatgtggaaataattatagcagaaagcttatagcctttattaatgaggtcaagctcaatttgagttaaatagcattttgtgggtttaatgtctcagaataataatctttaattttctctgaatcaccaatgtgatgtcaccaaaatgaaatgattgttacttttccgaaaaattcaataaatgcattgaattacctcca

SEQ ID NO: 7537 - DNA, 418 bp, Homo sapiens
gtctggatcctagaattgattctaataatagttttgccactgatacacatgagaaacccaggcaagtcacctacttatgctctattcatttcttcacatttaaaatgaatacattgaactagaacaatttttgaaatattctgtgactctaaaaattctatttactctggaggcaggtgttggtctactctttctccagtgataaaatatgaatatcaagatgtggaaataattatagcagaaagcttatagcctttattaatgaggtcaagctcaatttgagttaaatagcattttgtgggtttaatgtctcagaataataatctttaattttctctgaatcaccaatgtgatgtcaccaaaatgaaatgattgttacttttccgaaaaattcaataaatgcattgaattacctcca

SEQ ID NO: 7538 - DNA, 1089 bp, Homo sapiens
aaagttgttatgcataagtttcatagcagtttacttccttttcttgaatacagtttttaaaaccaagagtgagctttcagttttccataaaaatataagccgtactactttgacattgaaatcatcagtgcagccatcacttcttagaatttatttaaacttcttctcccaacagttttattttcttttagctgctaattattttcgaaattcatgaatgttttacctccttttactattctgaaagttatttcaagaagtggccccaaagcaggagaactgagaggggcaaattggcctggtttaattcacagcctgaagaattggcaacctaaagttataagttagatgtattttgcttttcaagccatcttctgagccttttttaggctgaaatgatttgtttatttcccaaattattgctagctacttgattttttatggctacctaacatccacatttggtagatacttttcctctctgcatgcatcccaaagaagaatttgctatttgtggaagaagagaataagggtatcagaatgaaggaaattacagtgactacactgtttatgactccattttgtgaattcttaaatatgctatggatttttttttagaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttgtaccagagcaaaatttgtatttaaaacaaaaaataagaatgcccatcactaggagaaacactcctcacagaaaacacacacacacacacacacacacaatttaaaaactgagtaaatttaaatgtatgaaagtaccccacaaattgatttcaacaaataaatttcatttctctagctacttatgtctggccttattttgagcgttacaattttattgccttcatttgcctatttagactga

SEQ ID NO: 7539 - DNA, 833 bp, Homo sapiens
aaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaaat

SEQ ID NO: 7540 - DNA, 465 bp, Homo sapiens
gactctttctcttctttttctttttcttcttctttgtcttccttttcttcagcctcatcatcgcttacttctttatcacgttccttctccacaaaaagagtaatgggatatccaataaactgagaatgtttcttcacaatctcctttattcttcgttccccaaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaaat

SEQ ID NO: 7541 - DNA, 448 bp, Homo sapiens
aaacttgaagaggcctatttttttttttttttgagacagagtctcactctgtggcccatgctggagtgcagtggtgtggtctcagctcactgcaccctccgcctcccgggttcatgctattctcctgcctcagcctcccgagtagctgggactataggcgcccgccaccacgcccggccaagttttctgtatttttagtagagacggggtttcaccgtgttagccaggatggtctcgatctcatgacctcatgatccgcccgccttggcctcccaaagtgctgggattacaggcgtgagccactgcacccggcctaaagaggcctatttttatttcctagctttggatcccagatgcaagggaggtgtaaggtagtggaaagagcacaggctccattccaaagctctagaggtcgagcgcctttaatttagtagtagtaggcggcggc

SEQ ID NO: 7542 - DNA, 688 bp, Homo sapiens
agggctatgtcatctgctagctcacttgtgaaggcagatggctatgggaagactgaagcatgggcctaggatttcaccagcaagtagtaatgggagacccttttttgggatttcccaggtcaggtggagattacacttagacaacaaataggaaatccttcagtgaggataaggtgaaggagatgaccttcctgtggaaggggaggtgggtcccagctgactggtaatgttaataatatcagcgtggtgaatatgtggggagtataattgtgttgtagaacagatggggaatgtagaaaagtgtaaagatgaaaaattaaaatcacataatatagcactgaaaagcactgcatgactgtcattttgaactagaaacgaacacagaaacatgaaaatgattggtttgttaaggcagtgggaaaggtaatttttttcctttcttttgacatctggtttgcaatggtttcttttagttcttttaatggaaacatataggtgaaagacagctataaaatattgctaaattttagaaatgtagaatgccattttgtttgttgcttttaaaattggttatcctcacttaaagcatattgtgaacttttccctaatgcataaacatttgtccaaaatatgatttaaatggctcctttgcattacatcacgtgaataaatcataattgatttaaaa

SEQ ID NO: 7543 - DNA, 531 bp, Homo sapiens
catgcttcattttcgggtgatatattctcagggccataatctaaaaaggaagtgaaaaaatccacttccctgggataaaaatattaaaacttcaggcatagaatttttttaaaattctatgagtatgcaattttaatggttttcaggaaaagtgtgttctttgtaattctcccaacagctcagaacttatttaagatgtaactgaactcattgagagacagcacatgctttatgttttgtaattgatgaaatgttccccctaaataaatctcacattgccagatctgatgacatgagtaataaaacataaccatgtgaaggaaatggctattttgagcaatatgcaggaaagagatattcatttggtgttgaaaaatagaacatatttttatgaaaaactacactctccagaccattgtagcaaacctcctgacattgagattggaggacatttcagggccaaagttgctaaagaaaaattctctgtttcaaactcaaaaattacggtgtttcagatagcatgtgcctcaa

SEQ ID NO: 7544 - DNA, 343 bp, Homo sapiens
tttcagagtattttctttcttgtccagattagctaaattggattgttctatgctaaattcacttaatcactactctattatttttgaattttttagttctgtttttttcacttggttctttttttaaaaaaacttctactacctttctgagacttctacttttttacttttttcaagaagctttataattacttgctaaagcatttttaccatgactgtttttaacttcttcagataaccacaacatttggttaatcttgaggttggcttggttaactgtcttttctcatcctgcttatgattttccttctaattgtgatttttccggttcttgatagatggg

SEQ ID NO: 7545 - DNA, 609 bp, Homo sapiens
  misc_feature (1)..(3): n is a, c, g, or t
nnnggctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacaatattttttagactccctcatctgtcagtgtgggtgcggataatgaaacaaaatgggcaagatgttggtaattgttgaagcctgtgcgacgagacttgggaagtgcaggattctctatatttttgtgtctgcttcaggatgtccatgaccactccctttcccctccaaaaaaaaagtt

SEQ ID NO: 7546 - DNA, 2037 bp, Homo sapiens
  misc_feature (1)..(3): n is a, c, g, or t
  misc_feature (1092)..(1092): n is a, c, g, or t
  misc_feature (1919)..(1919): n is a, c, g, or t
nnnggctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcagggctaccctgagaggaatctacatgcagagaagttcaggagactgaactaacggaacgtcaggaagcgctgcgggctggagagctgctgttggaacagggaggagttctccgggccgcaccctgcctccgtcccgcaggtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtggggtggctgaactgctattccttttctagggtgggatccccactctttgtaaggaaggatattggggtcctgacactgggaactcatcttgtcagtgaggccttctttaactgctgtcttgtaattgagccaccccatctgtgtttcctgttccaatttaggacttttttttttttatcataatataaagatctgaaatgctaaaatttccttattcattggcttattatctttactatcccatcctccacactaaaagttttttcgagctggatttgggagttgtggggtaggttatattttgatcacttgtatttcccagcttctagaacagtgcccagcaaagtacttctctgaataaatgaataaagtatattcctctgctctgctgttgccaactggaatatcctgagggaaatttctttactttcctcaggggatgatccagaagatgaaaaacaaattgtcattccatatagtcctcttctgagtgtttttcngttttgttaaaactcagattttttctttttacctgaatgtttttttgttaatgattattagcatatacagtattttcttttatgtaccaaaaaaaggcaattgatacagtgcatgacttgaaaatatacctgccttctctgaggctcaaattcaggactgtattatttggaaagccttgttgggttgtggctcccaagaaatcatacctaatttcccttctttgagagcactgatttctgagtttccatttctcctagaagagaaacattggcttgtaagaatttatgtatcatcaatgcttccttttccatcctgcacttagaaggacccaagacttgagggctgcgctgtcaacactattccttgctcaccctctcttttgttctaattatttatgtcttcccgccttcagaaatatcagttgctctttcaccagccattgtttcctctctggccctagtgcagagtaggtgacgtagtacagctgaaaggatgaatgctggcaaacttgtttctagcctagatttctccttattttaaatctgcacttgcaaccacatggcctgagacactcctcttgaaaatatcaccaaaaggaccttattataaaaagtcaccgccatctattcagggctatgtattaggggacaataaagtgtaagtcatggccaggcacggtggctaatgcctctaatcccagcactttgggaggccgaggtgggtggatcacgaggtcaggagattgaggccatcctggctaacacggtgaaaccccatctctataaaaatacaaaaattagcagggcgtggtggcgggcacctgtantcccagctacttggaggctgaggcaggagaatcgcttgaacctgggaggcggaggttgcagtgaaccaagattgtgccattgcactccagcctgggtgacagagctagatgtcatctc

SEQ ID NO: 7547 - DNA, 583 bp, Homo sapiens
aaaatattttttccccaacacttttcaaagaatggtttaaaagcaatgacaatccatgatcagtgagaattcccacccagattatggtctcaattcctttttcaaagggcagtcaggctacttggagacttgggtaaatctatggattttaatacattcaagaggaacagcaatcaaatgccatatttggatctggtgggatctcattcagacaaaatataaaaatatttgagacaattcaggattttctttctttaagggctaggtattggataatgttacacatcattttttaaattttcttaggtgtaaaatcttagcgttttttctttatatccatatctgttaggatatttgtgaaaatattcatgattaaaatcacatatttgggatttcatgtttcagatattttttagactccctcatctgtcagtgtgggtgcggataatgaaacaaaatgggcaagatgttggtaattgttgaagcctgtgcgacgagacttgggaagtgcaggattctctatatttttgtgtctgcttcaggatgtccatgaccactccctttcccctccaaaaaaaaagtt

SEQ ID NO: 7548 - DNA, 2195 bp, Homo sapiens
  misc_feature (1)..(3): n is a, c, g, or t
  misc_feature (1250)..(1250): n is a, c, g, or t
  misc_feature (2077)..(2077): n is a, c, g, or t
nnnggctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacaggctaccctgagaggaatctacatgcagagaagttcaggagactgaactaacggaacgtcaggaagcgctgcgggctggagagctgctgttggaacagggaggagttctccgggccgcaccctgcctccgtcccgcaggtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtggggtggctgaactgctattccttttctagggtgggatccccactctttgtaaggaaggatattggggtcctgacactgggaactcatcttgtcagtgaggccttctttaactgctgtcttgtaattgagccaccccatctgtgtttcctgttccaatttaggacttttttttttttatcataatataaagatctgaaatgctaaaatttccttattcattggcttattatctttactatcccatcctccacactaaaagttttttcgagctggatttgggagttgtggggtaggttatattttgatcacttgtatttcccagcttctagaacagtgcccagcaaagtacttctctgaataaatgaataaagtatattcctctgctctgctgttgccaactggaatatcctgagggaaatttctttactttcctcaggggatgatccagaagatgaaaaacaaattgtcattccatatagtcctcttctgagtgtttttcngttttgttaaaactcagattttttctttttacctgaatgtttttttgttaatgattattagcatatacagtattttcttttatgtaccaaaaaaaggcaattgatacagtgcatgacttgaaaatatacctgccttctctgaggctcaaattcaggactgtattatttggaaagccttgttgggttgtggctcccaagaaatcatacctaatttcccttctttgagagcactgatttctgagtttccatttctcctagaagagaaacattggcttgtaagaatttatgtatcatcaatgcttccttttccatcctgcacttagaaggacccaagacttgagggctgcgctgtcaacactattccttgctcaccctctcttttgttctaattatttatgtcttcccgccttcagaaatatcagttgctctttcaccagccattgtttcctctctggccctagtgcagagtaggtgacgtagtacagctgaaaggatgaatgctggcaaacttgtttctagcctagatttctccttattttaaatctgcacttgcaaccacatggcctgagacactcctcttgaaaatatcaccaaaaggaccttattataaaaagtcaccgccatctattcagggctatgtattaggggacaataaagtgtaagtcatggccaggcacggtggctaatgcctctaatcccagcactttgggaggccgaggtgggtggatcacgaggtcaggagattgaggccatcctggctaacacggtgaaaccccatctctataaaaatacaaaaattagcagggcgtggtggcgggcacctgtantcccagctacttggaggctgaggcaggagaatcgcttgaacctgggaggcggaggttgcagtgaaccaagattgtgccattgcactccagcctgggtgacagagctagatgtcatctc

SEQ ID NO: 7549 - DNA, 2057 bp, Homo sapiens
  misc_feature (1)..(3): n is a, c, g, or t
  misc_feature (1112)..(1112): n is a, c, g, or t
  misc_feature (1939)..(1939): n is a, c, g, or t
nnnggctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacagtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtggggtggctgaactgctattccttttctagggtgggatccccactctttgtaaggaaggatattggggtcctgacactgggaactcatcttgtcagtgaggccttctttaactgctgtcttgtaattgagccaccccatctgtgtttcctgttccaatttaggacttttttttttttatcataatataaagatctgaaatgctaaaatttccttattcattggcttattatctttactatcccatcctccacactaaaagttttttcgagctggatttgggagttgtggggtaggttatattttgatcacttgtatttcccagcttctagaacagtgcccagcaaagtacttctctgaataaatgaataaagtatattcctctgctctgctgttgccaactggaatatcctgagggaaatttctttactttcctcaggggatgatccagaagatgaaaaacaaattgtcattccatatagtcctcttctgagtgtttttcngttttgttaaaactcagattttttctttttacctgaatgtttttttgttaatgattattagcatatacagtattttcttttatgtaccaaaaaaaggcaattgatacagtgcatgacttgaaaatatacctgccttctctgaggctcaaattcaggactgtattatttggaaagccttgttgggttgtggctcccaagaaatcatacctaatttcccttctttgagagcactgatttctgagtttccatttctcctagaagagaaacattggcttgtaagaatttatgtatcatcaatgcttccttttccatcctgcacttagaaggacccaagacttgagggctgcgctgtcaacactattccttgctcaccctctcttttgttctaattatttatgtcttcccgccttcagaaatatcagttgctctttcaccagccattgtttcctctctggccctagtgcagagtaggtgacgtagtacagctgaaaggatgaatgctggcaaacttgtttctagcctagatttctccttattttaaatctgcacttgcaaccacatggcctgagacactcctcttgaaaatatcaccaaaaggaccttattataaaaagtcaccgccatctattcagggctatgtattaggggacaataaagtgtaagtcatggccaggcacggtggctaatgcctctaatcccagcactttgggaggccgaggtgggtggatcacgaggtcaggagattgaggccatcctggctaacacggtgaaaccccatctctataaaaatacaaaaattagcagggcgtggtggcgggcacctgtantcccagctacttggaggctgaggcaggagaatcgcttgaacctgggaggcggaggttgcagtgaaccaagattgtgccattgcactccagcctgggtgacagagctagatgtcatctc

SEQ ID NO: 7550 - DNA, 810 bp, Homo sapiens
  misc_feature (1)..(3): n is a, c, g, or t
nnnggctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacagtgagttggttgcaaactctcaaccctaacggctcttttaagagccacccatgttctcaaagaaagagctggtgcttgtattcctcctctgctggccactgacaaacccttgtaacttgctactgtgtttgttggtctgaagtagagcagttatttaactaatccttagtgacttttttttatttagatctgccattctaatcttagagttaagtaaggagatgggaaattttctattataagttcgaaaccaattaaaatacgttagaaaccaattaaaatactcgtcggtcccccgtcggttagtgatttggaacagtgccaagttgcagcggtggtcagtttgaatttgcccgggcaacgcccgcccttcctctgc

SEQ ID NO: 7551 - DNA, 1794 bp, Homo sapiens
  misc_feature (849)..(849): n is a, c, g, or t
  misc_feature (1676)..(1676): n is a, c, g, or t
attcgcggccgcgtcgaccctgtctggaatatctttatacaaacacaaataaacaaatgtgtcccctttcattcacatttgccccctttcattcaaatgactgatggtcacatgttcttcacaggttctgtctcttgcttttctcattaactgtctttcttattgcaggtggagtggctgaaacttctcagcaggcgcatctacactagtgacctgaggagagaaaccctaaccccacaatggctgcatcttctctgaagacgagactgatgctcatctttgaaatgaagggcagtgtgtgcatttctccatgaaggtatccagaaacagccatgccagagctgctgtggggtggctgaactgctattccttttctagggtgggatccccactctttgtaaggaaggatattggggtcctgacactgggaactcatcttgtcagtgaggccttctttaactgctgtcttgtaattgagccaccccatctgtgtttcctgttccaatttaggacttttttttttttatcataatataaagatctgaaatgctaaaatttccttattcattggcttattatctttactatcccatcctccacactaaaagttttttcgagctggatttgggagttgtggggtaggttatattttgatcacttgtatttcccagcttctagaacagtgcccagcaaagtacttctctgaataaatgaataaagtatattcctctgctctgctgttgccaactggaatatcctgagggaaatttctttactttcctcaggggatgatccagaagatgaaaaacaaattgtcattccatatagtcctcttctgagtgtttttcngttttgttaaaactcagattttttctttttacctgaatgtttttttgttaatgattattagcatatacagtattttcttttatgtaccaaaaaaaggcaattgatacagtgcatgacttgaaaatatacctgccttctctgaggctcaaattcaggactgtattatttggaaagccttgttgggttgtggctcccaagaaatcatacctaatttcccttctttgagagcactgatttctgagtttccatttctcctagaagagaaacattggcttgtaagaatttatgtatcatcaatgcttccttttccatcctgcacttagaaggacccaagacttgagggctgcgctgtcaacactattccttgctcaccctctcttttgttctaattatttatgtcttcccgccttcagaaatatcagttgctctttcaccagccattgtttcctctctggccctagtgcagagtaggtgacgtagtacagctgaaaggatgaatgctggcaaacttgtttctagcctagatttctccttattttaaatctgcacttgcaaccacatggcctgagacactcctcttgaaaatatcaccaaaaggaccttattataaaaagtcaccgccatctattcagggctatgtattaggggacaataaagtgtaagtcatggccaggcacggtggctaatgcctctaatcccagcactttgggaggccgaggtgggtggatcacgaggtcaggagattgaggccatcctggctaacacggtgaaaccccatctctataaaaatacaaaaattagcagggcgtggtggcgggcacctgtantcccagctacttggaggctgaggcaggagaatcgcttgaacctgggaggcggaggttgcagtgaaccaagattgtgccattgcactccagcctgggtgacagagctagatgtcatctc

SEQ ID NO: 7552 - DNA, 287 bp, Homo sapiens
cagcctccaaggcaggactctgacaccagggttataaatgcatctgtctgggcacattatctaaattgttatgtatcaccctgggtaatggcaaaagtaaaaaccgctgttagctcagtgaataaatccttggtgctgatcaatcattgcacgacatagactcttttaataggcacaatttacacagaggcttggcagactgcttcgtcttctaattgccgatggaaaatggatgccgatctctgctgtgccgtaaaaatgtaaactataaatgacttaaaaacttg

SEQ ID NO: 7553 - DNA, 500 bp, Homo sapiens
tatctagagatcctagctgttcttatgtcgccagccagcaagcacccagcctctgtaaggaggatgtcaggcctccagccagtggcccatcactcctgtaaaggacttcccagacccagaccagagtcctacagcctccttcccattttgactcaaggaccccagcagtatggcctggccctgtagctgtccaacagagggcagcagctcccgagctgatggggatggtgaggcagggacacctggagctaccaggctgctatgcaccggtcctcacctcgctctccctgccaccctgcagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaagagcaggagactgaggcctaggaggac

SEQ ID NO: 7554 - DNA, 2420 bp, Homo sapiens
agaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctcgcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaat

SEQ ID NO: 7555 - DNA, 2097 bp, Homo sapiens
gtagttagaggatcccctggagctggttttctccaatgtccttggggcaaggtcacccttccaggtaaaggcccagccccagccacagccactcctcccacagcctctgtaaggaggatgtcaggcctccagccagtggcccatcactcctgtaaaggacttcccagacccagaccagagtcctacagcctccttcccattttgactcaaggaccccagcagtatggcctggccctgtagctgtccaacagagggcagcagctcccgagctgatggggatggtgaggcagggacacctggagctaccaggctgctatgcaccggtcctcacctcgctctccctgccaccctgcagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctcgcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaat

SEQ ID NO: 7556 - DNA, 2075 bp, Homo sapiens
gacacctctagtgacacttccgggtcatcccgccacagaggctgcattaacctcagttgccctcagtgccttgctctcccagacaacatcaggcctcagtctaggtgccctgtctccagaatgcccctctagccaggggcacggcatttagggatgggatacctgtctagcacctgacaaattccagagtcacagtggcctctataagatgggctctgagccgccagcacaccccacccatcctgcccatcctgcccatcccgcccatcccatgttcctttgcaatctgccaggtcccttcctggctcacaaatgggaagtaagacagtctctccagatcttccagacgtggtggcccgccctccccaaagccaccaaaggtgccaagcctacgcagtggaatgtctgggccgctgtgcccctgtcctctgcagggagtggccagggtttggccagctgccggggcccctggctgcctcctgatgcccaagcctctccatctgcaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctcgcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaat

SEQ ID NO: 7557 - DNA, 381 bp, Homo sapiens
gagtcacttgaaccccagaggcagaggttgcagtgagccgaaatcacgccattgcactccagcctgggcaacaagagtgaaactccgtctcaaaaaaaaaaagaaagctgtactctgtcaagctcctgtgcatgtatctctctcaccctgatggccttcctgcaggtacagtgtccccatcatctgggtgcccctggtgctgtatctcagctggtcctactaccgaacctttgcccagggcaacgtccgactcttcacgtcatttacaacaggtaatgccagtttctttcctgacttgccctgaggatcctagagggaggagacctcagtgctttccctggcccagagtttctgagagcacagaaccccaaactacatcac

SEQ ID NO: 7558 - DNA, 2441 bp, Homo sapiens
gggggcggaaatattgctaggtcaggctggtgtgaatggcgaggagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctcgcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaat

SEQ ID NO: 7559 - DNA, 2205 bp, Homo sapiens
gggggcggaaatattgctaggtcaggctggtgtgaatggcgaggagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaat

SEQ ID NO: 7560 - DNA, 2154 bp, Homo sapiens
tccagtcttccaacctgggcgacacagagataccttgtctcaagataataataacaacgccctggctcaggagtgtcgccttctcttctccaatgtccttggggcaaggtcacccttccaggtaaaggcccagccccagccacagccactcctcccacagcctctgtaaggaggatgtcaggcctccagccagtggcccatcactcctgtaaaggacttcccagacccagaccagagtcctacagcctccttcccattttgactcaaggaccccagcagtatggcctggccctgtagctgtccaacagagggcagcagctcccgagctgatggggatggtgaggcagggacacctggagctaccaggctgctatgcaccggtcctcacctcgctctccctgccaccctgcagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctcgcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaat

SEQ ID NO: 7561 - DNA, 975 bp, Homo sapiens
gggggcggaaatattgctaggtcaggctggtgtgaatggcgaggagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacaggtaatgccagtttctttcctgacttgccctgaggatcctagagggaggagacctcagtgctttccctggcccagagtttctgagagcacagaaccccaaactacatcacagacatttttggtgaagcctctctgtagaaatagtcttccaaagaagaattttgtctgactcccatctaccccccaaatggatacaaaacccaacaacacatcagcagaaactaaatggaatcatcgggtggcatagcaataaaaaaagagagagagagagattgag

SEQ ID NO: 7562 - DNA, 2400 bp, Homo sapiens
  misc_feature (280)..(280): n is a, c, g, or t
  misc_feature (354)..(355): n is a, c, g, or t
  misc_feature (423)..(424): n is a, c, g, or t
  misc_feature (467)..(467): n is a, c, g, or t
  misc_feature (485)..(486): n is a, c, g, or t
  misc_feature (515)..(515): n is a, c, g, or t
  misc_feature (552)..(552): n is a, c, g, or t
  misc_feature (559)..(559): n is a, c, g, or t
  misc_feature (696)..(696): n is a, c, g, or t
atcacccattttctgcatcagtcacactgggagctgcagaccggagctgttcctatttgcccatcctctccctgctttctttacctctgaggttggattctccctgtggatcctgcaatccttctgccccaaaaaactattatagcaggagggaacctgttcctgctcactctttgccttctccttctcatcctagacagcctgaccgtgccctagttttcagaggagtgattgattctggggtgcggagaggatgaggaaactcaggctcagagagggntttccacctaatgtgcctggaaaccatgggtagctacccaataaggcctttctatgttagaaggtcatggaccnngagtgttggtatcggagctttgtagagacagtttgaccctgtacttagagcagagggtgtgtttgccnnggagagtgtgtgtgggcagctgtgtgtaagcctgtgtgagttntgtgtatgttcctgtgtnnatatatgtgtgtgctccttcatggacacngcatgcatgtagtgggcatagcaaggcagagagaaancaggagnctaggggcacagcccagtaggaagatagtatcttcctactgggcaggacttgaggtgtgcaaaggtgtgcatgagtactgcaaaagcagttcaaagagcagagaggtggggccagaataatatgttgcagaaaggcngtcatcagggaggaaagtgaggattccctgccaaaatgcctgagggcttccctgcctaccacagccctctgtgttcttaaatcctcctgtctgaacagaggccagactctggtttcccccacagcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttcgtgaccatactggacgtgaacttgttgggggtgattgatgtgactctgagcctgctgcccttagtgaggaaggccaggggccgtgtggtcaacgtctccagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtggtgtatccttgggagagatataaagtggagggagggagccgtccggtcagtagggcaccaatcccacctccttcattacctcctggccatgattctcctgggagataattctgctctctggagatgttggtaggaaagtttcaagttacgcagctgagaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtcttgaaa

SEQ ID NO: 7563 - DNA, 2614 bp, Homo sapiens
  misc_feature (280)..(280): n is a, c, g, or t
  misc_feature (354)..(355): n is a, c, g, or t
  misc_feature (423)..(424): n is a, c, g, or t
  misc_feature (467)..(467): n is a, c, g, or t
  misc_feature (485)..(486): n is a, c, g, or t
  misc_feature (515)..(515): n is a, c, g, or t
  misc_feature (552)..(552): n is a, c, g, or t
  misc_feature (559)..(559): n is a, c, g, or t
  misc_feature (696)..(696): n is a, c, g, or t
  misc_feature (2614)..(2614): n is a, c, g, or t
atcacccattttctgcatcagtcacactgggagctgcagaccggagctgttcctatttgcccatcctctccctgctttctttacctctgaggttggattctccctgtggatcctgcaatccttctgccccaaaaaactattatagcaggagggaacctgttcctgctcactctttgccttctccttctcatcctagacagcctgaccgtgccctagttttcagaggagtgattgattctggggtgcggagaggatgaggaaactcaggctcagagagggntttccacctaatgtgcctggaaaccatgggtagctacccaataaggcctttctatgttagaaggtcatggaccnngagtgttggtatcggagctttgtagagacagtttgaccctgtacttagagcagagggtgtgtttgccnnggagagtgtgtgtgggcagctgtgtgtaagcctgtgtgagttntgtgtatgttcctgtgtnnatatatgtgtgtgctccttcatggacacngcatgcatgtagtgggcatagcaaggcagagagaaancaggagnctaggggcacagcccagtaggaagatagtatcttcctactgggcaggacttgaggtgtgcaaaggtgtgcatgagtactgcaaaagcagttcaaagagcagagaggtggggccagaataatatgttgcagaaaggcngtcatcagggaggaaagtgaggattccctgccaaaatgcctgagggcttccctgcctaccacagccctctgtgttcttaaatcctcctgtctgaacagaggccagactctggtttcccccacagcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttcgtgaccatactggacgtgaacttgttgggggtgattgatgtgactctgagcctgctgcccttagtgaggaaggccaggggccgtgtggtcaacgtctccagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtggtgtatccttgggagagatataaagtggagggagggagccgtccggtcagtagggcaccaatcccacctccttcattacctcctggccatgattctcctgggagataattctgctctctggagatgttggtaggaaagtttcaagttacgcagctgagaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtcttgaaaaaaatgaactaaaaaaaactctaggtctaccggatcgataagcttgatatcgaattcggcacgaggataaatgtaacttcaagtcctgggctactgcttggtaattgtgcaatattgggcaggtccaggagagtctgattcagtgggaccgagttggcctctaaggaacctatgttttaagccgtgttcttatttatgacaatgcacttgatcn

SEQ ID NO: 7564 - DNA, 2560 bp, Homo sapiens
  misc_feature (280)..(280): n is a, c, g, or t
  misc_feature (354)..(355): n is a, c, g, or t
  misc_feature (423)..(424): n is a, c, g, or t
  misc_feature (467)..(467): n is a, c, g, or t
  misc_feature (485)..(486): n is a, c, g, or t
  misc_feature (515)..(515): n is a, c, g, or t
  misc_feature (552)..(552): n is a, c, g, or t
  misc_feature (559)..(559): n is a, c, g, or t
  misc_feature (696)..(696): n is a, c, g, or t
  misc_feature (2560)..(2560): n is a, c, g, or t
atcacccattttctgcatcagtcacactgggagctgcagaccggagctgttcctatttgcccatcctctccctgctttctttacctctgaggttggattctccctgtggatcctgcaatccttctgccccaaaaaactattatagcaggagggaacctgttcctgctcactctttgccttctccttctcatcctagacagcctgaccgtgccctagttttcagaggagtgattgattctggggtgcggagaggatgaggaaactcaggctcagagagggntttccacctaatgtgcctggaaaccatgggtagctacccaataaggcctttctatgttagaaggtcatggaccnngagtgttggtatcggagctttgtagagacagtttgaccctgtacttagagcagagggtgtgtttgccnnggagagtgtgtgtgggcagctgtgtgtaagcctgtgtgagttntgtgtatgttcctgtgtnnatatatgtgtgtgctccttcatggacacngcatgcatgtagtgggcatagcaaggcagagagaaancaggagnctaggggcacagcccagtaggaagatagtatcttcctactgggcaggacttgaggtgtgcaaaggtgtgcatgagtactgcaaaagcagttcaaagagcagagaggtggggccagaataatatgttgcagaaaggcngtcatcagggaggaaagtgaggattccctgccctgtctgaacagaggccagactctggtttcccccacagcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttcgtgaccatactggacgtgaacttgttgggggtgattgatgtgactctgagcctgctgcccttagtgaggaaggccaggggccgtgtggtcaacgtctccagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtggtgtatccttgggagagatataaagtggagggagggagccgtccggtcagtagggcaccaatcccacctccttcattacctcctggccatgattctcctgggagataattctgctctctggagatgttggtaggaaagtttcaagttacgcagctgagaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtcttgaaaaaaatgaactaaaaaaaactctaggtctaccggatcgataagcttgatatcgaattcggcacgaggataaatgtaacttcaagtcctgggctactgcttggtaattgtgcaatattgggcaggtccaggagagtctgattcagtgggaccgagttggcctctaaggaacctatgttttaagccgtgttcttatttatgacaatgcacttgatcn

SEQ ID NO: 7565 - DNA, 1608 bp, Homo sapiens
  misc_feature (1608)..(1608): n is a, c, g, or t
gacagatgcttcttagaggacagctgccatcacccagctcagaggccagggagattcctggggcaggaaaacgagggaggggactgaggactggagaggaggcaaaatgtgggaattctggtgatccactggatgtgagggacataggaggagacagcactaaggtgctgccttgctttggaattggtaggatttagggctagtaagctcaggtgtgtaaaatatggaaactccatacagagggaatgccaccatgataattatgaccccttgattgctggaaattaaatattccaagctttctattttacccattgtcctcatatgttgtgatatcatagttttacttttattgtttgtgttttaccttccaagacccccgaagtttttcccctctgcttctctgtcttgcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgaggggtggtgtatccttgggagagatataaagtggagggagggagccgtccggtcagtagggcaccaatcccacctccttcattacctcctggccatgattctcctgggagataattctgctctctggagatgttggtaggaaagtttcaagttacgcagctgagaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtcttgaaaaaaatgaactaaaaaaaactctaggtctaccggatcgataagcttgatatcgaattcggcacgaggataaatgtaacttcaagtcctgggctactgcttggtaattgtgcaatattgggcaggtccaggagagtctgattcagtgggaccgagttggcctctaaggaacctatgttttaagccgtgttcttatttatgacaatgcacttgatcn

SEQ ID NO: 7566 - DNA, 348 bp, Homo sapiens
tagcttattgtctttcaggcagtaggctggtccatgaagagtaaatggagaaagacctgggttttgtggcccaccagctgctgaatgctcagcccccacccctgtgatactgtggtgtttgttataccctcctccccatcccacacctgtcagtctgccctcactttattgggatgtgatttgcaccctaactctgtccacctgcacaggcacaacacagtgatgctctctcatcttcccactgtcccaggactctggggcctggtgaataatgctggcatctccttgcccacggctcccaatgagttgctcaccaagcaggacttcgtgaccatactggacgtgaac

SEQ ID NO: 7567 - DNA, 352 bp, Homo sapiens
gcattttatttggaatgggaagtaggttctaaagtcaatcactaaggcaaaatttctgtatagtcaaaattactcttggaaatccttttcagatctcagcattggagaaaattgctgttttctgggtgtagcaccagatgaagtagctggcttatatttagggccatattatgttaaaaaatccttcaaatgcaagaatcaggctgggtgtggtggcttgagcctgtaattcttgctactcaggaggctgaggcaggaagatcgcttgagcacaggagttcaaggctgcagtgagctgtgatcctgccactgaagtcctgcctggacaacagagcaagatcgtctcttaaaa

SEQ ID NO: 7568 - DNA, 342 bp, Homo sapiens
aaaatgattaaaagttcaaagtgcgtggctggggcttgtcatctgtgggtttcactgtagggcgatttggctgggctgtgtagttggggaaacctggtatttgtctttcttcttgggttgattagatccccagaaaaggctctaccaatctttccagcctggatgataaaggctggctgtcagcttgatggaagccgagttggggaagagaccgtctctgaatctggcaggctagtaccctccttatctccttattttcagttggtcccttatccttgtgctgtgactaatgatccccaatctagagaccttctgttccacccactccggagaataaacctc

SEQ ID NO: 7569 - DNA, 482 bp, Homo sapiens
catccaaagtgttcatttttttttaagaacctacagttacgagaagtaactgaagaagtgggaaatctggagaccaatatgcagaagaaggaaaaagacaaagactcatcctccaaattggatatttaaaccagaatttgtcatcctcagcaatattgatatattgggccagataattctttgtggagggttctcttggtgtgttgtcgggcatttagtaacattccctctacccacagaatgccaatgagacctcccgaccatgaccagttgtgaccacaaaaatgtctccagatatttccaaacgtcccataggaggcaaaatactcctgcagttgaaaattactgtgtaaaccagatctacatcctagatcttagaaaaaagatgtaaagcttcccaactcagccctgcatacccttgatactgaaataacagccttaaaggaaacaaacaaaactataatcttatttaatacagaagt

SEQ ID NO: 7570 - DNA, 348 bp, Homo sapiens
agtagacattctggcagctacatagtgacagctacatgggagactgaggtgggaggtttgagttcaggggtttgaagctgcaatgagctgtgatcaggccactgtgttccagcctgggcaacagaacaagactgttaatataatgaatgcatttggtaagggactgaaattgatagaaaactttaatgatcattacaattgatagattatcatggaaataactttcttgtttaaaaaaataaaactggcctggcatggtggctcatgcctgtactatcaccactttgggaagatgaggcaagaggattgcttgagactagcctgggcaacatggtaagacccgtcttt

SEQ ID NO: 7571 - DNA, 337 bp, Homo sapiens
gggaaagcaaacatgtccttcttcacatggcggcagcaaggggaagaatgagcaaaagaagaaaaagccccttataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtaccatgaaaaataaagtcctt

SEQ ID NO: 7572 - DNA, 634 bp, Homo sapiens
ttataaaagttaatgagttttggggaggaggacataggcttatcacaataataaaaaccactaacaaaccctttttgagcagctacaatgtattattctaagtacgttttatgtattaactcattccaccttcctaaaggtcctatgagtgttactcttaatcccacactgaagaaaaagcacacagggattacgtaatttggccaaagtcacaaagtacataaatagccaaaccaggaaatgtaaattaacacagtcctttcaatggcaatttggcaatagtcatcaacaaccttaaaatgtgctactcttgacttggaaatctcagtgctaagaatccactttaaaaaaacaggtttggacactatcttgatgcccaataacagatttactattctgaactgaacacaggcattcctctccactccttccccaaataccactaaaatgaaacttacaggatgaaaaagatataacgcggccgggcgcggtggctcacgcctgtaatcccaacacttggggaggctggggcgggtggatcacctaagtcaggagaccaggccggccaacatggtgaaatcccgtctctactaaaaatacaaaattagccgggtgtggtgtcgacgcctgtaat

SEQ ID NO: 7573 - DNA, 327 bp, Homo sapiens
atgttcatctcagaaatatgccttatgttaaaatagaatgaaagcaactgtatcttgtaccttctcagccaaagagctatgatcatttcactgtacttttctcagtgtgaatgatacacacagtgtgtttgtttactctgcttctcttctatgccattacccatttacccatggtcatgttaccatttcctcccacctgaaatactgtgataaccctctaactgtctttcctactattccaccttccaaaaccatggcctgttctgcaatcataattatatagttgtaaaaaatcacacctgatcatgttacctgcttgctgaaaac

SEQ ID NO: 7574 - DNA, 280 bp, Homo sapiens
tttcatgatactgcttgctaagttttttctgtttgcttcaccatattttgaacaattttctattaaattaggatattttaaaagtttgccttttcaatgtcttatttagataaattctgtagttccaaagttatatattttcaaagcctgatgcctttgatgtttgatgatgttaacaatatactattttcaaagccagtttgttatttctacactgatattgggaaaagaataaagtgatgaagtcaacaggtgttattaaaaatgtgaataacaggta

SEQ ID NO: 7575 - DNA, 471 bp, Homo sapiens
agtttaagcacagcacagtagtttcagtattgaacccaatgctttattttgactgcttgctaaatattcctcacccacttgcatgttttctgtaattcttaccatgtttgatagatctgtcactcctgtgacaaatgtatatgacagtcatatagtgaattggataacaaaggagtaatttggtgctgaaattattcaaataattgccattctgtatatgttacaattcagatcatcaaacaccccaagagttggagaggggaagatctgcatcattctagatcagctctggccaatggaaatatcatgtgagccacatatgtaattttaagttgtctgtagccacagtgaagaaaaaagcagaagtaggtgaaattaattttaataatatattttgtttaacccagtttcttcaaattattctttcaaaatataatcagtgtaaacattgttgagatattttactttctt

SEQ ID NO: 7576 - DNA, 514 bp, Homo sapiens
ccctcattacaacctaatgaagataaccatgtattatcttttcttaacaattcttcatagattatattttctccagcaaatttgtttgctgaaattatatcgtatatagggaaaagtcatttctcttttatatcatatattttcttttaatgaaatctgactgaaatgaggaataattttcactcctcttgctttatgacagtgaagtatctttcaagaacaaagttgggatatttgactttcattgtcctgagtaaaatagtgcctaagtcaaatagtacataaattatatttaaagaagtatagacaatatctagactcaagttctaaaataatgatagtcttctaaaaatgatttgctggaagaataattctgtaatcccagcttcttgggaggctgaggtgtgagaattgcttgaagctgggaggcagaggttgcagtgaaatgagatcaagccactgcagtccatcctgggcaacagaacaaaactctctctccaggaaaaaaaaaaaa

SEQ ID NO: 7577 - DNA, 779 bp, Homo sapiens
ccctcattacaacctaatgaagataaccatgtattatcttttcttaacaattcttcatagattatattttctccagcaaatttgtttgctgaaattatatcgtatatagggaaaagtcatttctcttttatatcatatattttcttttaatgaaatctgactgaaatgaggaataattttcactcctcttgctttatgacagtgaagtatctttcaagaacaaagttgggatatttgactttcattgtcctgagtaaaatagtgcctaagtcaaatagtacataaattatatttaaagaagtatagacaatatctagactcaagttctaaaataatgatagtcttctaaaaatgatttgctggaagaataattctgtaattgataaattctcttttaaagtgagcatgattcatagcttagatgagtgctgattttcaattatgaaggacagcagcatctctatttagaaataaaatcaaggccgggcacagtggctcacgcctgtaatcccagcactttggaaggctaaggccagtggattgcttgaggacaggagttcgagacctgcctggccatcatggcaaaaccccatctctactaaaaatacaaaaaattagccgggtgtggtggcacatgcctgtaatcccagcttcttgggaggctgaggtgtgagaattgcttgaagctgggaggcagaggttgcagtgaaatgagatcaagccactgcagtccatcctgggcaacagaacaaaactctctctccaggaaaaaaaaaaaa

SEQ ID NO: 7578 - DNA, 406 bp, Homo sapiens
aacacttgttttttaaatgattactggtagcatagttgacgccaactgatagtatctttttttgaattccacgtggtatcatcctgcctattattttattcttcggttttttcaatttttttatttctatttttgtttgtgtttttatttttattttcttttttgtaaaaaagcagacttttgacatcagagcttgtttagggattattgtggtataatattctggggatgacagaactgttttataccttaattttacctatgtaactttatatatgtcagaattcacaggggccaggcaggtgactgacacctgtaatcccaacactttgggaggccaaggtggcagatcacctgaggtcaggagtttgagaccagcctgggcaacatggtgaaacctcctatt

SEQ ID NO: 7579 - DNA, 330 bp, Homo sapiens
acttataagcccatatctgagtaacatcaaaacccattcttttaaccgttatactgtatttcctcccaccaatggcagctcctcacaagttgattgccattctcaccacaacacaggtttggtgtttgctgcctacctgacctccttctaggcactacaaactggagctttcagagtatgcacgctgtcattttgacttgatttgattaatgggcatctaaaccaatctggttggtggcaagctgccatagaaaaaaaccctatgcatataaaacagaaaatcagattttgccacatcctgactgggtgaatttgagattatgtcacacc

SEQ ID NO: 7580 - DNA, 382 bp, Homo sapiens
aactataaactaaacatctcccaaagttagcttagcctaagcccaggaataattaagggcagttgaagactaaaggcgaaagggggattggccagatcagatctcctccagagccataattttctcaatgatataattttttgcaaaggcaattacaataaggataatagtaatatccttacatgttccacataccacgacaagcatttcctatgcattgcttcagttaattttcatatcaatcttatgaaacaggatcctagagatgaaagccaaggtcctgctgaatgggaagccaggttgagaacttagtcctttctgacttcaaagcttgtgctttcactcctgtgttatgttggaatgcgagctttgaggatctctg

SEQ ID NO: 7581 - DNA, 346 bp, Homo sapiens
tggtaccatacatattcatgttaggtctttattgtgaattacagattttagaattaaaaaggagatttgggccgggcacagtggctcacgcctgtaatcccaacactttgggaggccgaggtgggcagatcacctgaagtcaggagtttgagaccagcctgcccagcatggtgaaaccctgtctctactaaaaaaaaataccaaaaattagccaagtgtggtgtcaggcgccataatcccagctactcaggaggttaaggcaggagaatcacttgaacctgagagacggaggttgtggtaagccaagatcgccccattgtactttagcctggacaacaagaacgac

SEQ ID NO: 7582 - DNA, 895 bp, Homo sapiens
gacctcagctttgtctgtctgaagctgcaggaggcccctgaggggtgggggagatggcaggcccaccagcgtaccctgtgctgatcatccctcttctctcttcttcagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccaccctaagggggatggctgtgaccctgcttcctgcactgacccacagcctctgcctgtgcacggccagctgcgtctactgaggccccaaggggtttctgtttctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaaagacactgaaagaatttggggtgcaaagtcagggtgggcagaggaggtagaagatcaactcagttgttgcatcattcatggttctttcatattgatgctcagtgcagtggcctgagaatatcccagcctctcttctggtttggtgagtgctatataagtaagcatggtggaattgtttgggggcagatatagtgacccttggtcactggtgtttcaaacattctggcaagtcacatcaatcaagaataatttttacttttaagaaagcataaccagcaataaaagtactatttttgattctaaaaaa

SEQ ID NO: 7583 - DNA, 909 bp, Homo sapiens
ttttttaaatcttttttttagatgccacttgtttgttaaactcgggagttgttcatttaacttgtactggctttcagaaggagactttgacttttttaaagaaatcaggtccatcactcaatgaactcattcctgatggttataatcgatgtcttgtagctggccttctttccccaagatttgttgatgttcagccttccagtttaagccaagaagaacagttagaagctatattgtcagcagcaattcagactagttccctgggacttttgactggttatatccgaagatggataacagaagaacaaccaaattctgccactaatttgcgctttgttcttgaatggacgtggaataaagtggttctcacaaaagaggaatttgacagactatgtgtgccattatttgatggttcgtgtcatttcatggatccacaaactatacagtctatccagcaatgctatttgcttcttagcaatcttaatatagtcttgagctgttttgcatcagaagcccgagagatcactgagagaggactgatagacttaagcaataagtttgtggtttcccacctcatctgtcagtatgcacaagtggttctttggttctctcattctgggcttttaccagaaggcatagatgattctgtgcagttgtcaaggttatgctacaactaccctgtaattcagaactactacaccagtcgtcgacagaagtttgagcgtttatcaagagggaagtggaatcccgattgcttgatgattgatggactggtttctcagttaggagagcgaattgagaagttgtggatacgagatgaaggaggcacaggaaaatatcctcctgctagtctgcatcgtatcttgatatgtacctattagaccgcgattcatgacgaggtacgctgaa

SEQ ID NO: 7584 - DNA, 251 bp, Homo sapiens
ctcctgccttggcctcccaaatcactgggattacagacataagccaccatgcccagcctcttctctctttgatagttgggattattacttttaatattttgatgctggttgctttgatattaattaacagtgatattaaataagtcttaatttttccctgattgcagagggaagtggaatcccgattgcttgatgattgatggactggtttctcagttaggagagcgaattgagaagttgtggatacgaga

SEQ ID NO: 7585 - DNA, 303 bp, Homo sapiens
attgagcattgattgatgccttactaatttatctgttacagactttgacttttttaaagaaatcaggtccatcactcaatgaactcattcctgatggttataatcgatgtcttgtagctggccttctttccccaagatttgttgatgttcagccttccagtttaagccaagtgagatgatttttaactctattgtttcttttggttggatcacgttattagctttctattacagtaaaaatgtattagataatttctgcaaaaataggtgaagtagtgtaatgctgactctgggtgatcagca

SEQ ID NO: 7586 - DNA, 388 bp, Homo sapiens
tttctttttcttttttaggtgagtattttaatttaaagttcaaaacaagttcagcagattagaatcccagattttttttagtgggggtattatcctcattttattattaaagggtgaaattaagccatagaatttcttcttaggaagctccctcctaggtaatgcagctgtcaagctatggacaaaccatttcacgtggttatttctttaacagtataaagtacacaagtgattcagctggggctttattcttgcctgcgtttctagaatgcttctaacctaaggcagcatttaaggtgttttatcccaacatctggaagtcatcatctaaacactcataccattaccccatgtctaatcttttgttctgctccttcatttgtttatg

SEQ ID NO: 7587 - DNA, 346 bp, Homo sapiens
ggcttttaaacaaaagcactgtatcatctgtgccaaatgtattccctgactaattactgagtacagtcacatagttatagtacactaataatacaggctggaaactgaagctcatagaagtatgtagtttccccaagagtgcagagctagtaagtggaagagtcaggattcaaacccagagcccctttctgaaatcctcagaggtgttcaacagcatgatcctcccttcctcttgacagctcgtatcctcctcctgaggtttagggcttcactctacctgacctgtgaagatttgaaagcacatatctaggacaagtattagaaagtcttcatacttcaggaaagg

SEQ ID NO: 7588 - DNA, 455 bp, Homo sapiens
tgttgcccagggtggagtgcagtggtgtgatctcggctcattgcaacctccgcctccttaggcaggaggattacttgagcccaggatttcgaggctgcagtgagctatgatcacaccactgcactccagcctgagttacagagtgagaccctgtctccaaaaaaaaaaaaaaccacctttttattaattttatcatttcgcatctattttcagatgcgagagtgtagtaattttctagataacttgcctttgaaagatacagtggccagaagacctgtttatttgaattctgcagttaccttagccttctcttttactttttttttttttgaagaaaaagttttttttctcatgactactagtgagttaatctgtcctggtattattttctgtgttaccagatagcatactggtctgagagagctctgtaaatatatatatttaaaaacccacct

SEQ ID NO: 7589 - DNA, 355 bp, Homo sapiens
aagatttgatctgcaattataagtaatctgccttttgaaattagcttcctgagactcagtcctgattggagaactgttaaagtgtttcagaggagcaggggttgtctatccgagcagtgtctcctgaatcatactgaatacttgagaaaatcagaccagctttatttgaactcaaatagtgacttgcttctcagcttccttcaatctcctgatgagagaaataggaaaacaggaaaaccttttgaaatcacattcaggcaaatttgcttggcttgtttcaaatcaaaccaaagtctggaactgatccccatgcaggagcgctaagcctctgcatagcaactaagccgcgttaaaa

SEQ ID NO: 7590 - DNA, 687 bp, Homo sapiens
ttttagttaaatctgtcttactacagtttgctaaattcatttttattttacttttagttaagcaatctaaacttagcattccctctgaatttcactataatcagattaaccatctcatatgttaactggaacaaccaaatacttactgagtgcctagtatgtgggccagggactttccagatgcttgggacagattgaataagataagatttctgctctcatagggctgagagctgtgtatctgtttagaagaagatgttaacttcccaggagaactcaagtaaaatgtgaaatagaataaggccacttggtcatgaggtcacaaactttgtgccaggcacactgctaaattggggcacaatacatggacatgtattgtaataaagaggacatgacccaaatgtttcagaaaatttaagcttataaaatttgatgccagtaaactcttggaattgtttaaatatagtagacttttcttatttttctcaatagtttattgaaaagttggtagataactttaaatgcttaaaatttcttaacagctaagaaagatatgaattgaaagatgtcattcatgatctttgttgcctttggtgtaggtatgaataacactagcatttgtgagggaaaagtgaatatgtacatttttattcataaaataaaaaaaattgcaaacaaccagttaag

SEQ ID NO: 7591 - DNA, 352 bp, Homo sapiens
tggaatttgaaattaaaaacacaataccatttatattagcaccaaaaaattaaatacttaggtataacataacaaaatatgtgttatatctcaatatctatatgcagagaactacaaaactctgatgaaataaatcaaagatctaaatggagatcctttgagctgcaaggtaaaaaatttaataaaaataaataaatacatgaagagagattctatgttcacgaataggaagactcaatattgtttagatgtcacttcttcccaacttgacctgtagattgaatgcaattcccatcaaaatccctgcaaatcattttgtggaagtcaactaactgattttaaagtttatata

SEQ ID NO: 7592 - DNA, 478 bp, Homo sapiens
tagagacatcttcagtttttatgtgggtagttacattaggcaccaagaagcaataacagtggaaaactgcaaaccgaatgcaagtatggggcagtttcttaatttggggtcagtggagcgctttgtggaatcaagtacaatcttgtgatcttgggtggcctgcctcactgtggtcaaacataaaacaggaataaaagtttctatttcacaggattctaagaggattaaacaagatagtttatgtgaagacactcatcaaggtccctgtcttctgataattaaacgtgaattcagtgtggatccctgtttatgttactgggatgtaagctgaaaggagttaggtaggaggctgttagcagtcacttggtatatttcacttgaacctgttccagtcgcaacacaccatggtaggtgtaaatatgggcatttctcaactggtttaggtcatgtaggaaataggtgctatcatcagattaac

SEQ ID NO: 7593 - DNA, 662 bp, Homo sapiens
ccagtctcccaggagaggtgtagacatgctttggtttctctctgatatgtatttattattgatcttcagtaaatttgactctgatctgttaacatggggctaatgatacctgcattgcagggttgctttaaaaggattaataatttgtaaaatgtgtagcccagaccccgccgtccactaagagctcagtaggtgtcactattatcattgatgccacttagcaaatatgagctctttaaatcattatgacaactttgaggggaagatacccttagtccattgtacagatgaagaaactgaggcttagtgaggagaatggatggcccctgggtcccatctcccgtcgctagagaactggggagcaagaattggagttctggccgggcatggtggctcacacctgtaatcccagtactttgggaggtcgaggcaggaggatcacctgagcccaggagttcaagaccagcctggacaacatggcgaaacgccacatctacaaaaagttttaaaaattagccgggtgtggtagcacgtgcctgtggtccctgttgcttgggaggctgaagtgagaggatcatttgagcccaggaggttgaggctacagtgagctgtcattgcaccactgctctctagcctgggcagcggtgtgagaccctgtctca

SEQ ID NO: 7594 - DNA, 394 bp, Homo sapiens
gaatgaggcagacaggtggggtggggagctttgagtcagtgttaaaattaaactaaggccactttctgtgggtatacactgtaagggaaaaatggattattttgtgaactctgttagaaaaaaaaatacatcttaagttgtgacaactggaaaagaatagattttactctctctgtgaagctgaaaatgaattctctatatggtaaaccttgaaagtagagatgtagtaacattattagtctttaccggtgccgtcttataacagaggctgcacagattagcagagaccatgagggtttcaacgaaaaagtatattcaagtcttaatgcaaaatataataatgtttatcagtaaaaagaattactaaaaatatgtactgcacacggtcactgta

SEQ ID NO: 7595 - DNA, 238 bp, Homo sapiens
gtcctcaaatatagatgatatatagaaatacattgaacaaatgagaaacaggttgtgaaaatagaagcaaggaaaaaataaagaacagaaaattaggtgaagcgagctagaaatggtgctgaaaatcacatcgataaatccctgtgcagttgcaaaggtggccccaactgggggcctgcactttccaacagccaggatctgttgggaaacattatcagttgccagattgatgacattc

SEQ ID NO: 7596 - DNA, 886 bp, Homo sapiens
tgagtgaacaactctcagttctaaccatgccctttgcttccttcctttgaagcccagccctacgaaccatctctcttcaattcataacaagcacgtttgaatccaagagcctaagccccagttttctacacgtatctgtgctgactgcattactgaggtcaaccttaatcaccctgggactgtcaaactattgatgtccataaggattctctgtgctggcattccacacacacgcagcaaggttcaatgagccacagtacttactctctgacctctattatttcaaccatttaaaaattgtggccacgggaggctgaggtgggaggatcgcttgagccctggaggtcgaggctgcagtgagctataatcccagcactgcactccaacctgggcgaaagagcgagaccctgtctcaaaaattaaattaattaattaattaattaaaaaacaaaaaaaaaagccgtggccagcaaaagaagtagattatgatctccaggacaatatgttttgtacataaaatgtatttggagttttttgttttcattaaagttgaggtccctccctactgtgatgtcaaacccaacaatgggtcaccccacaggacaccacccctgctcgcacctgtaatcccagtcctttgggatggcgcaggtaggtggatcacttgagcccaggagttcaagaccagcctgggcaacgtggcgaaaccctatctccacaaaaaacagaaaaattagctaggtgtggtggtgtgtgctagtagtcccagctacttggggggctgagtcaggaagatcgcttgagccagggaggtcgaggctgcagtgagctatgacagctccactgctctctagccttggccacagagcaaggccctaattaaaaa

SEQ ID NO: 7597 - DNA, 383 bp, Homo sapiens
aaggagatgtgagatacacaaaagttaatggccacaagaagccctaatgtctccaacttggttagctgcagagatgccagttgctttaaaatcatgctaacctcttcctcctttctacaaccccaaggagcgtttctcgaaggagcctcaaagctccatttttcgctgcaaagggaatatcttttaactttgagggaggaagtatgaactaagttatttattctctttaattccataacctttgccaaggagaaatgatatactcattatctcaggagttcagctggtcactgtcttgccttgaaaaatcgctggctcagctcctgtcagataaagactttggtgtactcagggtttaatgagattaacggcttttatagtac

SEQ ID NO: 7598 - DNA, 372 bp, Homo sapiens
ctagaggattcccgggcagagtcatggagcccctaatgtctccaacttggttagctgcagagatgccagttgctttaaaatcatgctaacctcttcctcctttctacaaccccaaggagcgtttctcgaaggagcctcaaagctccatttttcgctgcaaagggaatatcttttaactttgagggaggaagtatgaactaagttatttattctctttaattccataacctttgccaaggagaaatgatatactcattatctcaggagttcagctggtcactgtcttgccttgaaaaatcgctggctcagctcctgtcagataaagactttggtgtactcagggtttaatgagattaacggcttttatagtac

SEQ ID NO: 7599 - DNA, 433 bp, Homo sapiens
gccttacgatccccgtttactggggagtagggaggctgctgttacaaatctcaatgtcccgaccaacccctacctgttgagctcttcaggaggggccaggcatggatgctgccttcaaagctccctgctgatacataccgctaagctgaagacttttgctccagtttcaccatacaaatgcatctacaaacaaaatcttatttccgtagggtttaagtcaagtcaaaatcacttgtcctatatattagaaagtcctagaggagaagaacacaaggaaagcgtggactataataaagacaactcacgtgtccacatttctggggtctggggaaaaaaggcaatttgttttgtataggacacacataagccaccaggcatcaaaagaggccaaataaaactccaactgaggccgagtgcggtggctcacacctgt

SEQ ID NO: 7600 - DNA, 485 bp, Homo sapiens
gagagcattaaagagggtgaaaaatttgactagagtctgttggtttttttcccctttccctggaacaaatggttatatttgttttgtgtaccattttatttcatttttcttcaataagttataccattaaaacagaatacatgggctaggaaatgcaagttggcttctgctggtaaggatgcagtcccagttttcttagtgaggaaagacagttttcatgattttacatacttatgttttccttttatgggcagcataatttaaacctttggaattttttttttttttcaaattagttttttttcctgcaagcagtactgcctgttttatctgattgtggcccaaagcatcgaattgctacttaatgaatgtttattaattaaaaaaagttttgttaagatttctcaaaattcagttcagtttaaaaatatcgtggccaggcacagtggttcacacctggaatcccagcactttgggaggccaag

SEQ ID NO: 7601 - DNA, 926 bp, Homo sapiens
ccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaatagaagaaattcaagtgctttctttttcctatatgtttttttttttttatctgaattctcagatactgcctcctaactgtgtccaaacttcttgtgtaataaagagattctgttttcgatcctaagttctttgggatgccaacattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatc

SEQ ID NO: 7602 - DNA, 377 bp, Homo sapiens
gactttcttatatccttctctcagcaaaatcaggatgtttattagaacaaaactagaattagcttatttccctaccctgaagcaaagtcacatatagtatgttctaagtgctgggtctcaggataatgccattgtgctgttagtctgagtgtgtcagatctgggtacatgatagctgtcctcccgtctgtaaagtactgtggaagctccaggcagagctaggaccagaacccagatcttctaactcctcaccccagcattctttctccttacgcatgctgcttcatggaactcagagatgaaatcacataaagcaaatactcaggaatagccttcagttcctcaccactcagaaaataggaaagaaagacaggatgg

SEQ ID NO: 7603 - DNA, 149 bp, Homo sapiens
taatgtgcatttgattatgatgatggcaacactgtatgctgactcggggcatgcataattaattggaagcgagttccacgatcagattaatatttcatttcccctctcagaaggaaggctatctcagtgagatataacctcttctgctt

SEQ ID NO: 7604 - DNA, 730 bp, Homo sapiens
agtttccttatctttaaatggaggtaatcacagtacctacctcagtgttgttgtgaagatttaatgagataataacctgcagagcacttgagagtctcaagaaatatgagctcttataacattattgctattgtaaaacattgctattacttctgtcccaatttggcagtttcaggaaattgagaaggaatgtcactgaatctttaatgccagttacacagagctcagtaggtgtccgcacagccctttagatgcacgtagcctatttgatcttcgtatcagccctgtaaggttgggcttaagaatgacccagcatggaagtactcttgggaccacaggggaagcaacagtccttgtaagctgtttgtcagtgggccttagcaaccaagccccaagtggacagaaagatggggttctgtgagcatccattccaagggtcactttaggggtgcaatcttctgggctctgagaatggattcacagcagcatctctatctggaaatacctttgctttgtccaagtaacctcctcccacacagagtacccgaatcagctcagattttttttccttaatattggcaacacttaatgctacttctttgttcgtaacatttcatttaattatttaaaaatctgcaaatgttgtgtatattttaccgcaatttttaaacaaactccagtgtagaccgtgctctagcatttctaaaaataaaagtaaatatgttaaaat

SEQ ID NO: 7605 - DNA, 440 bp, Homo sapiens
gttttctcagacaggatcctaggatgtgtctggaagcctgcggagtgaaggtagacatgcaggtgtgatgttctgcctgatagtgcctctctccaggcattaactacaaggctgggtgggggcttacggtaaggcatcgagtccctaagcatttatacagtcccaattgtgcatcagtgcagtgctggttataacagggaagaatttgtggaggggagggcacaggctgaaattggcccattcctacacatgctcttgacctagacctagagtaagtgacattgaccccaaccgtccccctacccacctccagcttgtgccagacatcactaatcagtcacagcgcttctttccagctgaatccagactcagaatcctcattagagctcattgttagcacgtcttcctgaagtgcaacccatttgccattccttccctgg

SEQ ID NO: 7606 - DNA, 765 bp, Homo sapiens
ataaaggagcttccaattgccaaatccgggacaatttgagaaagaaaataaataatgactgtaatgagttatatagcccacagaatcaattaatatgaatgtgttcatagtatataaataattgggtaaacatgtcagtggtgggagggagagctcttccctactcattctgactaatgtagaagaaatgatgggaacggaaaattgctgtttgacaaaccacagtggtaatgggtacagacaagaacactcagtggacactaaagttagggggcaatgtgtgttgtgaaacggggtatctgcagagtcttgagaacctcccctgaagatgcttagtgactccccaagggaacagtagtaacctcacagtagacacccacccctagctatgcggtcatcacccagatatgtgcatgcagctcgtagccctgatatcatgcactgagaactcggcatcactgctgtggttttcttgcccaaaatgtctcttgtccaagtactaaccaggctcgaccttgcttagcttccaaaatcagacaagatcgggtgtgttcagggtgatgtggctgtagactcttgcccaaaatgtgtagcctgaatctgatcatgaggaaacatcagacagaccaaagggccatgctacaaaataattgccagcacccttcaaaagtgttatgtaagatgttatctaggggaactggttatacaaactctgtcctatttttccaactttttggaagcctgaaattatttggaaatgaaaag

SEQ ID NO: 7607 - DNA, 368 bp, Homo sapiens
  misc_feature (169)..(169): n is a, c, g, or t
  misc_feature (198)..(198): n is a, c, g, or t
atcatctatcctgtatgattgtcccaataattaataataaagtactatagtagcaacttgtactctcttgatcctaacaaaaccctgtaatgggcacttaagtccctgggcaatccttgcttaatgcttttgttgactcaacgagggcccgaggcttgagggtttctantaaggtacgggccctaggcatgcaggctngatggcattcaagacccgggctcaaataactagcctcaatgtattaagtaaggcactaatgaggggcattgcatattaagtaaagccctaggaaaggcattgagatagaggttctgaggacaaagagggctctaaatcaacaatcttaaccgaaaaatacacaaaaaact

SEQ ID NO: 7608 - DNA, 389 bp, Homo sapiens
tccacataccgaccattgcagcaacacatggctacctagggagaccttagcttttgttcggcttcttccaggaaactcaaaccagatcagggaagaggcagaggaggttaggaagtgagaaagccgataatagaaagggaacaaaatgatacgtattgctcagcatcctgttggtgatcctcttctgtcagagcactaagacaaaacaacggaagggttggagacagagaacacctttaatttgatgaagacatgattattgtctacgtggaaaatcaggagaacctctagaaatattagcaccaatacaagagtttttttgcaagtccgtgtatataaaattaacatacgtaaattagtaacattcctgtgccatagaaataaccaat

SEQ ID NO: 7609 - DNA, 1446 bp, Homo sapiens
ctaagtaataaaacacatagcatgattctctctccctctctctctctctctctgcccaccccctgctagtttccaggagaatacttctctaaaattcatttttttctattttggaataaattatctttatacagtaattcaaacactgatttccattaacctttggccctgagttttcttctaacatagaagagttcattttgagaggcactcagttaccattcaatctgtgctgtaagtatgggactttgtacaaatgccctttttgagggccaaaaatttcaatacactttgttctactttgtgaaccaggtctggatctgcacagagaaagtaatgctgagctgtccaaagagtccgctcaggtctccctcctaaccctcctctgccttcccctagtttgcttatcctcacgtctgacactgaggagtgcatagtcttcaactgaaatggcactacagttagttctcattggaaacaaacaagtgtatttctggaacctgctcgtctaaaatagtcaatgcctttgtaaagactcagcatattcaatatctattgtatggtagctagctatatacatagattgactatttttagtcctggtttgtgtattgttgagctatagtagtttgctttatccatttgtgggattaaacaatactgtttaatggttgtaaacttttataaaatctctttgggttttttgtttgacccaaacataatgtaagtcttaatgacaaaatacacaaagttaaccagaggtgagtgaaaatatagcccttccccagttttgtctgcccctataatgcacgtgcattgctttgtaatatgctctcgctagcatgaatgtgctatgactacttcatgaggttttgtttcacctataattgtgatggaaaatgctgtattgctgacaacaatgaactgtaaccacagttatttactgcataaactatttgtgtactaaccactcatggctctgtttctttaagaataccaacaacaatgggccgggcatggtggctcatgcctgtaatcccagcactttgggaggcgaagcaggcggatcacctgaggtcaggagttggagaccagcctggccaactggcgaaaccctgtctctactaaaaatacaaaaattagcctggtgtcatggcacgcacctgtaatcccagctcctcgggaggctgaggcaggagaattgcttgaatccaagacttggaggttgcagtgagccgagatcatgctactgcactccagcctggacgacagagtgagattccatctcaaaaaacaaaacaaagaaacaaaaaacaacaacaacaaaagccatgccacacatacatatacatatactacatatactctagtttgctcctaaagtattagatttatgtccttgcgacttatattttgagattaaaaactataaaggcagggatttcc

SEQ ID NO: 7610 - DNA, 250 bp, Homo sapiens
caaactgtgaaaatttattatatagaacccttttttatttccatattttagtttcaaaatatacctgaacaaatgcataaataaccaatcctctgttatttaaatatataaccatgctatgttataataagagcacttgtagaattttagtaactataaaaatatttcagtagcaaagccaagattataaatgttttgatcccctacagaatggagtaaaagtgatgaattgcattgtatgagaatcagt

SEQ ID NO: 7611 - DNA, 345 bp, Homo sapiens
aatatttaaaaatgtttttaaacatttgctcccaagaaaagaagttaatagtagggataagcccagaggaattataagtgactacatttccatctatgtaagaacttgtgattttctttctgtttgaattggattgcatttgcctaggaagttaatgacattttagtagcaatagaatgttaagaatgcctatgaacagttcttaattgtggggaagcaatacttcattttttacacttagtatataaaaatagttaatttttataaaaatactttatataatacttttaatttagtataagcatttttcatagtagggataaggaaatcttttgtttttataag

SEQ ID NO: 7612 - DNA, 1499 bp, Homo sapiens
ctcagtgcccttctggggaaggacatgtccagtgaagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaaaaaaaaaa

SEQ ID NO: 7613 - DNA, 558 bp, Homo sapiens
ctcagtgcccttctggggaaggacatgtccagtgaagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccagagcttcctgtcagtaaccatgttttcaataaatactctttcatgtacaaaaaaaaaaa

SEQ ID NO: 7614 - DNA, 422 bp, Homo sapiens
aattcaaggcctgagagttctatggtggaagaagagtccagtttagcctcttcacctggcccacatctccctcttgggcctggcattttctaagtgcctgctctgcctggtaccatgttggttgttcctaaagcatcatcttactcaatattcacaacctcccagaggcccagctcaggaggatactgccagaataggccttttccttctcactcgtcaaggtctcagctagggtgttgtaggcttaaagggaagaactggaggcctaggtagccccgaggagcacacagtcattccctcaaaacaaacagcctggaggctcacgtcatcaccagctctgggcaacagctgacagaccactgctttcctccaccaccactccccatgctggctgctggcctcttgacaggttgatggcttgg

SEQ ID NO: 7615 - DNA, 212 bp, Homo sapiens
gcttcatttaaaacaaagtaagctgaaggaaggaaataaaactgagtaaaaatcagctaattaaagataaaacatgcaagagtgaaaatcaacaaagacaaatgttggttctttgaaatattaataacatatgcagtgaattttattttatttttttttacatggagtctcactcttttctccaggctgaagtgcagtggcactatcttggc

SEQ ID NO: 7616 - DNA, 1002 bp, Homo sapiens
ggggagtggaaacctggtgccaagccccaaagactcattgcagtaaagccactccgtcctctctgagtccacaggggaagctggccaaggtcacagaccctagctgccttgtggacaggacaagagtgcacacagtgcaaggcccagcctgaccttagctacggggagggcagcctgctttgcgggggagaatgagctgagggacgagggagataccttgggtaatctgtgcccgttggggcagaggctctgtggtggcaggctccggggaggccctgacctaccgccatgccggttcagcatctgttttctgacttgaaggaggaaggatgtgccgagcagctgaggaatgacactcagtgcctggcattttggaggtgccctgacactgggtggggctcagtgcacaaacagcagggtaccgggttcctggggccagtggcctctgctgcttatgccccatgtctcagggtccaggacgcaccaccagctctaggcttctttctctgtgttcatttccggagctgtggcaggtggcttagaggggtctaggccatgagaggacatggaatcttgcttctgcttggcaggaaagttcaataggagcgtcttggctctgtgacctctgatgagatgattttattgtgagctttctgttcacccctcgccagtgctgcctgaggtcacattccctgatgggaaagtagaggagacgaaagtagagggttctgcaggcccatggtgtggggggtatgagggtgtgtcccccagcacctgctcagtggggatcagaggcccctccctacccaccttatccctgggctggcacagccccacacacacaccctgagccctggctcaggactctgggaaaaccttaagctgatataggctcctgaagtccatcaccaaccctgatgaggaagcctgtcatagattcagatcagaatgatacttgagcactgctggcttaattaagctccagaatcaattttttcaaaa

SEQ ID NO: 7617 - DNA, 817 bp, Homo sapiens
ggggagtggaaacctggtgccaagccccaaagactcattgcagtaaagccactccgtcctctctgagtccacaggggaagctggccaaggtcacagaccctagctgccttgtggacaggacaagagtgcacacagtgcaaggcccagcctgaccttagctacggggagggcagcctgctttgcgggggagaatgagctgagggacgagggagataccttgggtaatctgtgcccgttggggcagaggctctgtggtggcaggctccggggaggccctgacctaccgccatgccggttcagcatctgttttctgacttgaaggaggaaggatgtgccgagcagctgaggaatgacactcagtgcctggcattttggaggtgccctgacactgggtggggctcagtgcacaaacagcagggtaccgggttcctggggccagtggcctctgctgcttatgccccatgtctcagggtccaggacgcaccaccagctctaggcttctttctctgtgttcatttccggagctgtggcaggtggcttagaggggtctaggccatgagaggacatggaatcttgcttctgcttggcaggaaagttcaataggagcgtcttggctctgtgacctctgatgagatgattttattgtgagctttctgttcacccctcgccagtgctgcctgaggtcacattccctgatgggaaagtagaggagacgaaagtagagggttctgcagggcagagtaggtgagacctcgcatcttcctggggctgtgtcttgcccagttgtcaggcagcaaacagcgctgagttgctacca

SEQ ID NO: 7618 - DNA, 318 bp, Homo sapiens
agaaacttctacactcaaccacataaacctcataattcagagtagttgaggctgtattcattgtggcattcttcttccacctcattaaataccaggcaggcccctttgatcaggtctccatggcagtgctgcccctggtacacaagtgtgtacccatttaggaaaagacagtaactgcttacctgcacaacctaattatatggagatatggtctcagtcctttaacagtgagacagaaacagaaatccaagctccagggacaggaaagtctactgagatcaaaaccccttcttttgccccacaaaaacaaaacaaaac

SEQ ID NO: 7619 - DNA, 239 bp, Homo sapiens
gaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctc

SEQ ID NO: 7620 - DNA, 430 bp, Homo sapiens
tattattatatattttacatttatgtattttgcaaacaaaaaatttacgcatttattactttatgtaatttttgatctattaaaatgtggagagaagaaaggagataaagtacatacttacagagctgggtatattagcttttaggttctctttatttttcctgtgaactcattataatctgacatcgttttcttattccaacacagttttgtccctactaattttttcatgatgttattgtcaaatgtgcttgatttctatatgttttagccccaatggtaaaattatatacaaattgttttatgtagttttcaaataagctaaaagaagacatgcacttatactatattttaaaattagcaaaatatttgccttcactgatgttccttttttttttttttgcctgtggacctaatatagtattaaatg

SEQ ID NO: 7621 - DNA, 320 bp, Homo sapiens
ccagttaggtttcattttattttgataggactcaggtttttcatcctttaaatgagaagctttaaccttaaagtaggagcatctttaaagtttttcaggtctagaatactgtgttctaaattggtatagtattttattgcatcatttaactctttgttgatgtactatgggattattctttcagtaacatttgatccagactgtctttgtttctccttttagtgatctagtaaattatgaaatatgttctttaatatactttgctttttaaggaaagttgaagaaaattgatcatttgttcgttcatttaaaaaatacaa

SEQ ID NO: 7622 - DNA, 361 bp, Homo sapiens
tttcatctttgttgttgttgttaaatagaggcagggtctctcactctgtcatccaggctggagtgtggtggcatcatcatagctcactgcagccttgaacttttgggctcaagtgatcctcctgccttggcctcccaaagtgctgggattacaggtgtagccaccacactcagcttctttcatccttttgctgactaatcagtttagtatttttttttaaacatttccattacaaggtaacctaggaagagatgactgaaatcataggcttatatgtttgccagccccctcttccaaagaaactttaaaaagaattggtgtctcataaaaatctactatgtatcatctcttccgtcgacgc

SEQ ID NO: 7623 - DNA, 148 bp, Homo sapiens
catattctttgatgcttttctgtttatgaaattgtgttacagactgcgagtaacatagcttaaatgagaagataagtaattactgcctttcaactgatacatatttctgttgaaaggcagtaattacttatcttctcatttaaggtcg

SEQ ID NO: 7624 - DNA, 396 bp, Homo sapiens
ggagaaagagaagatgctggtcaacaggtacaaagcttcagttaagcaggagggataagatctggtgttctatatactggatcgtgactatagctactaataatgcactgtaggccaggcaagatggctcacacctgtaatcctagcactttgggagaccgagacagcagatcacttgaggtgaggagttcgagaccagcccggccaacatggtgaaaccccatctctactacaactacaaaaaaaattagccaggcatggtggtgcatgcctgtagtcccatctactcaggagcgctgaggcaggagaatcgcttgaacccaggaggtggaggctagagtcagccgagattgtgccactgcactccagcctggttgacagagtgagactccatct

SEQ ID NO: 7625 - DNA, 188 bp, Homo sapiens
ttccaactgcgggacttgcctcatccccactcacagggaagtcacatcctgaagatgccacaaacagctggagacattcggaccgtatggagtcttgcaattggatgccagtcccaccagtcttgcaatcttcccacatccagaacctttccatcctctgtctaaaaatagcagttgtactctccaca

SEQ ID NO: 7626 - DNA, 600 bp, Homo sapiens
ctgagcttcacaccttgggtcagatgtgtgttgtcagctgagaaactgagctgcattcttgagcatgagccagacgccttgacagatggttattcttttctgcttgacctcgagttacagagatgcagatgaagtcaaagaggataccagatgcagccagtctgctggggaggcacgtacgtctgagcgggcccagcacagctgttctccagggcaaggcttggccatggcagctgccccagcgcccgcattcagcccaacccaccaggtcaccccagtccagtccgtggtgctcagatccccaagcaatcacaggtcagaggcggaaagaactacgtgaatgtgtacagtgatattgggcacatgctctgaaggaagggaaaccgaagaacgtcaaggggcagcgttcagaggaggggaaagaatgcagagtctgggtgtgatccctacctggactctcttagaagctccactatcctcttctctaatgatctgtcttcccattccagaatttcttaccttaacctacttagcctgagttaaataagcatctgcatgcagaaataaataagtgagggaatttgtacttttctgcaatta

SEQ ID NO: 7627 - DNA, 300 bp, Homo sapiens
gctgagtggcagagtaacagacagttcatcaaccttatttcacagagacagccaaccaaaatgagaagcattacttgttctgtgataaaaagccaaatggaagaagataatatagaaagacattggtgaagcaaggaggtggaatacctgtgtcagtggctagacaagaagcaccataagatgctgaaaaggtgagaggccaagagacgcgtttcttaagaagcgtggtcagttcaggctgcggtaactccatactgggctgcggggctttgtcttgttttgtttgagccatgatagtga

SEQ ID NO: 7628 - DNA, 761 bp, Homo sapiens
cagtcacggtactcgtttccagacagaagtcatgaggaacaagagggaaggtgctttcccgtgtgcagcgcttggggagactcacacagacagaggatctggcatgacagggaaaggaggaaatggcttctgttaatctctccttcagcttctcccgcccttcccatgcactcttcctgtttccctttccagttctcacggtgactcaaggaacaacgtgtgaaatgaaagacctcaggtgctgtattggctcttgacagctcttcagaagaaaatacctcctgcctgttctgttcagtcctggtgcaggtggtcctggacaacactttgaaaaatgctggggcagaaacaagccagcaagcatatgggattcatctgctgtgagtgataatttatctagtttctaaaaatagtgttataggctggactgtgtccccttcctgtgccccgccgccatgcatatatggacgcctagtacctcagaatgtgactgtatttggaaacagggcctttgaagaagtaattaagttaaaatgaggtcattagggtgggcagtaatacagtataactggtgtccttataagaagagattaggacacagatgcacacagagggaagaccatatgaacacagagggagaagacagccacctgcaagccacagagagagcccttcaaagaaaccaaccctgcagacaatttgatctcaggtttctggcctccagaattgtgagaaaataaatttctgttgtttaagtcaac

SEQ ID NO: 7629 - DNA, 377 bp, Homo sapiens
tgagatggagtctcactctgtcaccaggctggagtgcagtgtgcactggcacaatcttggctcactgcaacctccgcctctcgggttcaagcaattctcctgccactgcaacctccgcctctcgggttcaagcaattctcctgcctcagcctccctagtagctgggactacaggtacgtgccaccatacccagctaatttttgtattgttagtagagatggggtttcaccatgttggccaggctggtcttgatgtcttgacctcgtgatctgcccgcctcagcctccctgggattacaggcgtgagctggcgcccagcctgccccaactctctataggcaggaaggaggctgagaaatttgctcaaccatcaaaagc

SEQ ID NO: 7630 - DNA, 422 bp, Homo sapiens
gaaaagttgtggtccccagaatttctgtcctccctatgctagcacgaagggataattgatcttcagacattgaaaagagatagcaggcaaaacaccggggctggaacaacacagcaggatacccagggatcccaaaaggaagtcaaagaagagattggagaaaagcagtggtgaggaaaagggcattgcccccaaaaagtaatgtctcccatgcagagaagactagcattacataaatgtgtcactgagagagttaccttaccctgactctgtcaccaaattttattaaatgcctctcctatttcatccttgttggtgaacttcccagttcttctcttattttatgggcataagagcttatactttgcagtttagttagttaatttatttaaatagcattatcaagttggctctagactaaa

SEQ ID NO: 7631 - DNA, 394 bp, Homo sapiens
ctggaaccacaggtgtgtgctaccgtgcctggcacttttttgccttcttaatggagatattcagttttctttttttcatttaaacaaagaaaaaaaatgtatctactctaccttccctctgctctcctccctccctatcctactctggaaaaaaaaacaaaagatatactttcaatcttcaaaagttagctggagacattatggaaaagaacatttgtggttcattagatcgcttcaactttattgtttctactctgtgaatttttagtaggaatagcactttgttatttaagaggtgctttacttttatatgaacaagggtctcctaggactgaagaaaatggaagataaatatgtgaaaccacttactcagtacgagccttttgactaagta

SEQ ID NO: 7632 - DNA, 412 bp, Homo sapiens
gatctcaggacagggagcccacagaggcctggggaaggttctggatgggcttgacagctgtgcttcccaaagctcactgcacatcagagtcctctggggaactttttcaaagatacagcttcctggccgggcgtggtggctcacgcctgtaatcccagcactttgggagggcaagacaggtggatcacctgaacccaggagtttgagaccagccatggtcaacatggcaaaaccctgtctctactaaaaatacaaaaattaaccgggtgtggtggcgcacacctgtagtcccagctactcaggagtgagtagctgaggcacgagaattgcttgaacccgggaggcggaggttgcagtgagccgagatcgtgccactgcactccagtctgggtgacagagcaagactccatct

SEQ ID NO: 7633 - DNA, 810 bp, Homo sapiens
gagacagaatctctctgtcatccaggctagagtgcagtggcacgactcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaaatatttaaatgaaatttattttaggcaccaagcaccacataaactcataataactatttgcaatgcattagcatcactcacggggtaatgaaaacataccttagctgctgtaaaagcaaagtcttccgtgtccgggtgggctgaaagtttttaataaaattttagctaaacatttgtttaagtgaatactaaggatg

SEQ ID NO: 7634 - DNA, 1248 bp, Homo sapiens
gagacagaatctctctgtcatccaggctagagtgcagtggcacgactcttggcttactgcaacctccacctcccaggttcaagcaattctctgtctcagcctcccgagtagctgggattacaggcatgcaccaccacgcctggctaatttttgtatatttaagtagagacaaggtttcgctatgttggccaggctggtcttgaactcctgacctcgtgatccacctgccttggccacccaaagtgttgggattataggcatgagccaccgtgcctggctgatgctggagcttttatgtgacatggtgactcttaaaactggggagggacgtagagatgagagtttcacacaccagcccataggtgggatgtcaagacccatcggaagtgtcgctggcctaagagaagagcacttatttctcaccatggctgatctagaattgttccctgattctgaaagaagtttacactacactggtaagcagtactattagactactgactgtggccttctgtgcatatggaataatgatttctcagatttgtaggcttgaatgtgaatgttattttatcagtaatcagaataaattgcttatattcaggagttattttaacataaacaaaaaaaaacaaaaaaaaaaacaacaaaaaaaaaaaaaaaaaaaaagcaaaacacacaaaacgcaaacaaaacaaacccaaaggagagcgaagagcggagggacgagcggcaggacgagacgcggaggcagaggggacgagcagaccgaacgcgcggagcgcagacacggccaccgcggggccgccaacgggaacggcgcggcaccaagagaggaggaccggcgcagcgggcggagcggcggcgagggagagagagggaagaccgggcggacccagagggcggcgcagcgccgggaggccacagcggcggagcagcggcggcgcgcggcgggcagccgggggcacgcagtaccgccggcgtcgggcgcacaggcgccgagcgcgaacagacgcgggacgaaccgtcgcgaggcagagaagcgcgaggagaggacagcaaacgggagcacgcgaggcgcgaaggacgggacagcacgaggcgcgcagccgaggagagaccggccgcggaccgcccgcggcaccggcggccgctggggcgcacgccgcgccgcggcccgcccccgcgccgcccgccccgcccccgcccccccccgcgcgacccccccgggcgggacgacgggcgacgaca

SEQ ID NO: 7635 - DNA, 346 bp, Homo sapiens
ctgaggcaggagaatcaggcagggaggttgcagtgagccgagatggcggcagtacagttcagcctcggcttggcatcagagggagactgtgtaaaggggagaagagggagagggagaccgtggaaaggggagacaagagtgagagggagctgaaatttttttttaattcttgtgaacacatggttctaaatgctaaattttatagtaatcttttcccagcaatcttttggtaaaaatcaatgaaattgggacccttataggtcaaaataaatgttcaagaataaaaatggtcaccaaggatcatgagtcatttcaggaaagcctttatcctaaaagtgaccaacac

SEQ ID NO: 7636 - DNA, 1182 bp, Homo sapiens
ataggcttgccttatctttgtctgatctcttaatcacttgggaatgaaaatatgataatataggtggcggctcactaattcttattcattctattcttaatttatttttattattaaaaaaatgtgttgcctaggctggacttgaactcctgggctcaagcgatcttcccacctcagcctcctgagtgactagctacaagtgtgccaccgtacctggcttcattctgtttaacatttcttaaaaacactcttcctttcttttccatttgggaattaattttctgtttttagtttcatgttccttagaaaccatctttcacatggttgtcacaaaaacttttttttgatacacattcacttatctgcttaaacacctttctcttaaagtattctttctgtgaaatatttcatattcaagatgctccctaaatggtgagttcacagtttgcatgtaagtttggtaattttcaggtgattctttgttccctaaacatttcgcgatattctataactctgcctaagttgttcccctcagtctggaattcctttggtgttcactactcataatcagttccttttttataggcttctagaattcacagatggtttttaacatatctgtttataagttcattttgtgggccaggctgagtcgttctgtggctgcatttgctgaatacacctctgagaatgccccctacagtcgagtcatattttgttaaaaatgcttcctccacactatctgagacctattgactgggaaccttttcagagtgaaatctgggaatgtgaatttttaaatgcacccccagtgcccaaattgcagcacctctgctgtacagtagtggcaggaacttactcttcttcctaagtgtcaggcccccagtaaactagaaaaaaacatactaaataaattggagagaacaataaaactagattcaaaaaataggtccaataaattcagaatgccactaggtatatactaaaattgatttgggattgtgggttaatgtgactaaatgtcccttgtgttctttttaaaaactgtcaaggctaggtacagtgggtcacaactttaatcccagcactttgggaggctgacgtggaaggattgcctgaggccagtagttcaagaccagactaggcaatgtaggaagaccccatctctacagtcaaataata

SEQ ID NO: 7637 - DNA, 432 bp, Homo sapiens
ggaggcggtggcattttttaaaaagcaagcacattggagagaaagaaaaagaaaaacaaaaccaaaacaaaacccaggcaccagacagccagaacatttttttttcacccttcctgaaaacaaacaaacaaacaaacaatcatcaaaacagtcaccaccaacatcaaaactgttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgaggtaagcgagtctgcgggcaccgaggctccccgagtccggccaactccagccagacggggagatg

SEQ ID NO: 7638 - DNA, 2632 bp, Homo sapiens
ctcgctgctcccttcctccctgtaactgaacagtgaaaattcacattgtggatccgctaacaggcacagatgtcatgtgaaaacgcacatgctctgccatccacaccgcctttctttcttttctttctgtttccttttttcccccttgttccttctccctcttctttgtaactaacaaaaccaccaccaactcctcctcctgctgctgcccttcctcctcctcctcagtccaagtgatcacaaaagaaatcttctgagccggaggcggtggcattttttaaaaagcaagcacattggagagaaagaaaaagaaaaacaaaaccaaaacaaaacccaggcaccagacagccagaacatttttttttcacccttcctgaaaacaaacaaacaaacaaacaatcatcaaaacagtcaccaccaacatcaaaactgttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgagcacaaattgaagtgataccatgcaaaatttgtggcgataagtcctctgggatccactacggagtcatcacatgtgaaggctgcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatgctgtgaagtttgggaggatgtccaagaagcaaagggacagcctgtatgctgaggtgcagaagcaccagcagcggctgcaggaacagcggcaggagcagagtggggaggcagaacgccttgccagggtgtacagcagcagcattagcaacggcctgagcaacctgaacaacgagaccagcggcacttatgccaacgggcagcgtcattgacctgcccaagtctgagggttattacaacgtcgtttccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcgaccgaattgcacagaacatcattaagtcccatttggagacatgtcaatacaccatggaagagctgcaccagctggcgtggcagacccacacctatgaagaaattaaagcatatcaaagcaagtccagggaagcactgtggcaacaatgtgccatccagatcactcacgccatccaatacgtggtggagtttgcaaagcggataacaggcttcatggagctctgtcaaaatgatcaaattctacttctgaagtcaggttgcttggaagtggttttagtgagaatgtgccgtgccttcaacccattaaacaacactgttctgtttgaaggaaaatatggaggaatgcaaatgttcaaagccttaggttctgatgacctagtgaatgaagcatttgactttgcaaagaatttgtgttccttgcagctgaccgaggaggagatcgctttgttctcatctgctgttctgatatctccagaccgagcctggcttatagaaccaaggaaagtccagaagcttcaggaaaaaatttattttgcacttcaacatgtgattcagaagaatcacctggatgatgagaccttggcaaagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatc

SEQ ID NO: 7639 - DNA, 4407 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacatgctgggattacaggcgtgagccactgcacccggccgtgaccaacattcttaatctgtcctctagtgctggccactctaaaacttcacaagaatgtgctgtctgtgtctagcttcttttacccaacatgaggttgcatgggcttggttcattcattctgttccatgaattcatcacaatatatccattcttttgtccaggggcatttggcttccagaaacctacccctaacaccagcccttccctccctctgcagaacaaaggccccatcagaggggacgtgctgggtgtcagcgtcagcttctgggaggaggaaggtcagagctaaggcctgaaggatgatgaggtatcaggtgggtggaggggagacgctcaggaggtgggaaaggcggaggtgcacaggcttggttccaggtacaaataacgttactaggagcacacagtacctggattttgatgaatacattgtacatttctgtcctgtatgtatccagggttataggacgtgattataggacacgcatatatgtttggttttagtggactcttaaaaattgttttccaggggccgggcacagtggcttacgcctgtaatcccagcactttgggaggcctaggcgggcagatcacctgaggtcaggagttcaagatcagcctgaccaacatggagaaaccccgtctctattgggaggccgaggcgggaggatcacaaagtcaggagatcgagaccatcctggctaacacggtgaaaccccgtctctactaaaaatgcaaaaaaattggctgggcgtggtggcgggcgcctgtggtcccagctactcgggaggctgaggcaggagaatggagtgagcccgggaggcagagcttgcagtgagccaagatcgtgccactgcactccagcctggttgacagagcaagactccgtctcaaaaaag

SEQ ID NO: 7640 - DNA, 387 bp, Homo sapiens
attcggcacgagggcgactgtctccgaaccttctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7641 - DNA, 464 bp, Homo sapiens
gtccggaattcccgggtcgactactactactaaattcgcggccgcgtcgacgggggctgggagcactggtgttcacgtgggaccacaggctgcaccataagacccactcacaataaaaaaataaaaggccgagccgggcatggttgctcactcccgtaataaaaaaataaaagaacaggctgagccgggcatggttgctcactcccgtaatcccagcactttgggaggctgaggcgggtggatcgcctgaggtcaggagttcgagaccagcctggccaacatagtgaaaccctgtctctactagaaatacaaaaacttagctgggtgtggtggtgggcatctttaatcccagctactggggaggctgaggcaggggaatcacttgaacctgggaggcagaggttgcaatgagctgagatcatgccattgcactccagcctgggcgacaagagtgaaactccatc

SEQ ID NO: 7642 - DNA, 386 bp, Homo sapiens
atacggaaggatggagacagttgaaataggaagaaccccacaaaagctggagataatggagaacgatgctgaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggc

SEQ ID NO: 7643 - DNA, 615 bp, Homo sapiens
atcccctcgctctctctctctcttttttttaaattagggtctcgctcctgttgcccaggctgagtgcagtggcacaatcacaggtcactgcagcctcgatctcctgggttcaagcgattctcctgcctcagcctcccgagtagctgggattacagtcatgcaccaccactaatttttgtatttttagtagagacggggtttcaccatgttggccaggatggtcttgaactcctgacctcaagtgatccgcttgccttggcctttcaaagtgctgggattacaggcatgagccacaacgcccggccaacactaggaattttaaaacgtcatgaatttgtgatctctgagccccgctgtgctgcacagtggctcttgtgttccccaatcttgggggttttgcttctcattctagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattggtgagtacccacccccctcctgatcact

SEQ ID NO: 7644 - DNA, 4034 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggc

SEQ ID NO: 7645 - DNA, 4171 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccgatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7646 - DNA, 3092 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagatttccacacgcaggcaagcacgcgcgtgctgaccactgcgtttcgtggcgcccgaggtgtggcgccagagctggggcagatgggaggagcgggaccgaaggagttggcgaacagctcacgtcggttcgcgggcacagcgctgggaggtcgcccgcccaccccggttacggtggccactgggcccccgggggggggggccaaagaagaacaggggcccctaaacagaaggacatggaaaaagcagaaacagagaaacgcacag

SEQ ID NO: 7647 - DNA, 4353 bp, Homo sapiens
cggacgcgtgggtcgacccacgcgtcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7648 - DNA, 2328 bp, Homo sapiens
aggctgggtgtaaatcggacgaggctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7649 - DNA, 1521 bp, Homo sapiens
ggggtgatctagaggatcccggctgatggcagacagattttccacacgcaggccaagcagggcgccgtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7650 - DNA, 330 bp, Homo sapiens
ccgcttcgtagtagattccggtaaggaccaccatgagcccctacccaccacccccaaggacttaggagcatggggtccggaggtgtgcgtgtgtggcaggggcgcaccagcttggattgggaagtacagttgactttcccatatccaaaatgcttgcttgcaaccagaagtgtttggaatttcgggtttttttgaatttggaatatttgtatcaattttattatttgagtatgtcaaatccagaaatctgaaatcctccagtgagcatttcattggagggtcacgttagtgctgaaaacatttcagattttcgagcatttcagactttgg

SEQ ID NO: 7651 - DNA, 376 bp, Homo sapiens
tgcagggagacagaccactgatgtgacagtgacaacccagagagggctggaatggggagtccagggggctgggacaacccagcggggcatctaacccagtttgtgggtagtctgggagggcttcccataggagggggcactggggctgagacctggaagcaggagagcaggtgtccctgagggatgcccattttggggctctgggtgctcggtcagcccctccctccccgcactggccaggccctgacaccctggcgtctgctcctccacccaggtgaaatctgaacggagcagaaactctcgcaagtggtgccgccgccggggcatagaggagcatcgactgtacgaaatggccaaccttcggcgccagttcaag

SEQ ID NO: 7652 - DNA, 505 bp, Homo sapiens
agaccatcccagccaccccccatcttcctggcctctttggcagctccaccctgtccccccaccccacaaaggggggctacgcagtcactgacttcctcacctacaactgcctcacggtaagcatgaaccctccttccctgaaggtgggatttcaggaagaccccaccaccccgtttcaccttagtccagggacatagttcccaagtggggcccgtggccctgagggcttctgggaagggtcccgggggggcacttgggtggtgggtggcacttggcgggggcccagccctgacagctggcctgccacagaatgacacagacctgtacagcgactgtctccgaaccttctggacctgcccccactgtggcctgcatgcgcccctcacgcccctggagcgcatcgcccatgagaacacctgcccccaggccccacaggatgggcccccagggtaagcacaggactgtggggacccggccacctctgcccagccgtctgcccatccca

SEQ ID NO: 7653 - DNA, 748 bp, Homo sapiens
ctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctctcagtctccatgtctctccttgtgtctttctctctgtctctctcactggcagggatgcggagtaaagacagacctgtgtatttttattaatctgggagggcttcctggaggaggcaaaactgggttctccaaaggccaggagagaacctgagccccacaggtgcctggcatttgggtgcgggtagacctgtgcactggaacacgcccctcacagcctcctccttttcctcccttaggggcgggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggc

SEQ ID NO: 7654 - DNA, 4389 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7655 - DNA, 4721 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccgggcatggttgctcactcccgtaatcccagcactttgggaggctgaggcgggtggatcgcctgaggtcaggagttcgagaccagcctggccaacatagtgaaaccctgtctctactagaaatacaaaaacttagctgggtgtggtggtgggcatctttaatcccagctactggggaggctgaggcaggggaatcacttgaacctgggaggcagaggttgcaatgagctgagatcatgccattgcactccagcctgggcgacaagagtgaaactccatc

SEQ ID NO: 7656 - DNA, 3170 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggtacagtgagcccaggcggaaggaatccccatccgggatgtgaggggcagggataccgtgaactcccaggcccctctggctggggctcccacaccggcccaggctggtattgacgggggcccacaggaggggaagttccagggccaggcctccctgggtagccttgggtgactcacccctgctgggcctcaccttccgcatggtggtgatagtcaacctaagc

SEQ ID NO: 7657 - DNA, 2695 bp, Homo sapiens
acgagatggctgtgtgcgcaggcgcaagactagcgctcttgggaccggaagttaaggcgttcgcggcgtgtgaatccaggcctgaaaacccagaatgaacttgtgtccatcccagagatcactgcagatgtcatgaggtaccctttgtgtcaccagctcaagcaggcctctggccactttatcatctgtggtggtcctgtcccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggtgggcgccatgggctgtggggtgtgggggtttaccaagg

SEQ ID NO: 7658 - DNA, 2587 bp, Homo sapiens
aagcaattctcctgcctcagcttcatgagtagctaaaattacaggctcacgccaccacgcctggctaatttttgtatttttagtagagacggggtttcatcatgttggccaggctggtctcgaagtcctgacctcaagtgatctgcccacctcagcctcccaaagtgctgggattacaggcatgagccactgcgcccggccaatatttgtttttttagtagtgtcaaggtttcaccatgtcggccgtgctggtcttgaactcctgactttaagtgatctgcccacttcggcctttcaaactgctgggattacagggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7659 - DNA, 1103 bp, Homo sapiens
ctctgtgttgctgtctttgtctctgtttctgtctctctgtggctatgtctcttgttatttttctctgtcctgcagctatctctgccttggtcacctccaccctgttgtcacccagggatgccacacactggggttcagtgggggagatagcactggggccacatgcctccatccccggctggctgtgtctgcctctcagtctccatgtctctccttgtgtctttctctctgtctctctcactggcagggatgcggagtaaagacagacctgtgtatttttattaatctgggagggcttcctggaggaggcaaaactgggttctccaaaggccaggagagaacctgagccccacaggtgcctggcatttgggtgcgggtagacctgtgcactggaacacgcccctcacagcctcctccttttcctcccttaggggcgggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccga

SEQ ID NO: 7660 - DNA, 527 bp, Homo sapiens
aaggctttcattttggttcttctgattggtgttacctactgcctaatatgtgttcattttttgacagagaggcagactattgaaaaagtctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 7661 - DNA, 608 bp, Homo sapiens
atacctaatattatacctaataatagtaattatagttgcttactgataacaacaactaataacacttattgaggccctactctgtgccagggattttctaatcacttaattccctaacacattatgaggttttattgttttctccaattttacagacagggaaactgagacatggagtagttaagttcatttacccagtgtaacacagctggcagtctggttttagattttgtccaatgcacactgtgtggcactgcccaggagcataagctccttgtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 7662 - DNA, 1983 bp, Homo sapiens
aaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagagcagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacccctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 7663 - DNA, 1427 bp, Homo sapiens
aaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagagcagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 7664 - DNA, 1630 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctgggtgctgtgcctttcttttttagagatgtgctctcatctcttctctgacccccactttgccagcaaatattttttatttctgcttaaaatgtggtgtgtttggggatgccccacacaacaagacaggcttttccctgagaccagcagctgaatttctgccctgaaagggaggtgggcc

SEQ ID NO: 7665 - DNA, 417 bp, Homo sapiens
tggtgtggcaccaatcagaccccagggattgaagatggagcagccccagctctcattccccgttgcctgcctgagagccctggtgatttctttccagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttgggtatgtctctccctctacaatcaactttgtagtcctagcaggtgattagcgtaggcttgagtatgggaccttgatatcttccatagtacctagaagaggagatagcatattgatgaaatttaataaatgggtttattgaaagagatcaat

SEQ ID NO: 7666 - DNA, 1440 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgat

SEQ ID NO: 7667 - DNA, 473 bp, Homo sapiens
tgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcactttgggaggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagac

SEQ ID NO: 7668 - DNA, 469 bp, Homo sapiens
gtggcaaccatataaaggctttgtcacgttttatacatttctagggtttcacactagtataacttttttttttaatgtattgcaaagttggaggtgtttgtacaagtactgtcacatctttcaggtttgtagagttccttttcagcatgaattatcgtttgtctcttaagaattgagaacttatgactaggcatggtggctcatgcctgtaatcccagcactttaggagactgaggcaagtggatcatctgaggtcaggagtttgagactagcacggccaacaaggtgaaaccccctctctactaaaaacacaaaaattagccaggcatagtggtgggcacctgcaatcccagctacttgggaggccgaggcaggagaatggcttgaacccaggaggcggaggttgcagtgaggtgaaatcatgccattgccctccaacctgggtgataagagcaaaactctgtctcaa

SEQ ID NO: 7669 - DNA, 510 bp, Homo sapiens
gttggcacggaactgagggaggaaactgggactacccgcctgatgttgcagcttttttattctcccctcgtcactgtgagaggtctggacttcttctgacataaacagcctcctttcatcaaaggatcgtgccatcctttctattttctaagcattaaaaggcagtttaagcagatcagtgaattaggcaaacgtttatattctcccttgcccttttctttttgcatctggtagaatttctcctgttctattgttgatctctttgtaaaagcccgtacattcttagctgccagggcatgtctttggaagcattaccacatacctgtgaatgattaataagctgtgtttggttaataagcaacattcagctctcatattaatcacagatttttaaagttagacacagctggtgacaatttagtgacacagggtcagcttagcttttcttgagcattagctgggaggagaggctgaacgctgccagatgtcaccaaccaaaaaaaaaaaaac

SEQ ID NO: 7670 - DNA, 925 bp, Homo sapiens
gcaccacactatccactagctgtacaatttacagagaagcacaagattcatcttgtcacctacaattcgtcttgaacatgttcatatttagtactcagaaactgtgtaagctcctcccaatacagaaaatattttttaaggcagcatatgtatttctgatttactaaaaacgattgtcattctcctctcattcttctttttggtatgaaccaaaagcggctaggagcaatgcctcaaataaccagaaatgaccttttgttgatacaaattgtatctctttttttcctgattgtatagaaacaaatgtacaaaactcatctgaagctaggtttggcactgaattttcaccatgaggtttgtggcactgtgtgtcacagggaagtagctcaggggttgtgagggagcttttatttctaaagggcagtagtaatttatagacaaaaacaatttttcaaggcctctttattaccactgcacagctatcatgtgtaaaatttcaagcattatattgcataagttctctttagcctattaaatttaatatgtccttgcaaaagggattttgtgtaaaaagtgtcagtgttagtgactcatctgcaagaatctacaaatggagctatacaactatgaatacataaatacagcatggttcctagttattagagaaacattttctttatattgaggtctacgcacttcttgactttccattttgtctgtaattataaaacagcaaataacaaagaagcattgggaccccctcggctgccttgataataaaatcaagcttccttcatgggactaagcatgtgtccttcaggatacttacctctaagcactcagcaggggttactacaaagcgttttgtgtggttttcaaaaaacagtgtattttgcaagaggtgctttgtaattttaattatttc

SEQ ID NO: 7671 - DNA, 232 bp, Homo sapiens
ttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccat

SEQ ID NO: 7672 - DNA, 931 bp, Homo sapiens
gtaaaatgagaacagaggagttttgagtatttattactgtcattttaaacatttgtttcattgtaagttctataatgtaattttaaaataatggctatgtttaaaaatcagcttgcaaaattcttgaaaatttagcaattggctttgtgagagggtgagggctttcatcttccctggggaaaatatgatcccagcccatgtgggcgacacatctcaccaaaccccaggccctgggggtgagcgctgcacgtggtaagggcatgggagggtcttgtgagcatcagaagtcttaaacttgaagaaagaagcctcttgtgtgtagcagaggccccaaccccacctgttgactagaaaattgccatgcactgtggtcaccatgtgggagtaaaaccatgaacttccacccaccataggcagaagtgaatcattcagacagagccatccagaaggcacagatggcttcctgaccccatttgacctgggctgggtactccatggagctcaagctcaaggtcggctctgtcagccccaaaccccagctttctgctttggaagtaccagcttatatccccaccctttcccccagcccaggaagggagtaaagccaaaggggttccaggggaacctaagaccttggcctgggaaggtgatggttgggacccatgtgactgggcatgaccagaacgaattggtgttttccctaaggaaatcccttgccccaaactctcccctgccagctgctctgtggccttggagacaagctatttctctggttatttgctccaagttcacccagagctggaagacaagtgtggctgaggcacctgcatgaaacagcagggagagaacaggtgctcaggagtcactgggctgggttcccatcttgccatcacctctgcatgtgtgaccttgggcttgtcacttaatctct

SEQ ID NO: 7673 - DNA, 322 bp, Homo sapiens
tttatttaagatgaagacagtgacacttaagttactttcaagtttaaagagatatttataaagtacttcgaacttttttgtgggagcagtactatataaataaaatactgccattcaaatacagcccccgccccaggtttgaatgtagaggtcaatgaactatagagaaaatggtaacaaataagatatgaccaaaaagtggcaataaataacacggggtcataaaaatttcataaaatcctcttttaaatatgaagggggattttttttttcattacatccctgggtgtttcagctcctgactatccagctagtagaatat

SEQ ID NO: 7674 - DNA, 266 bp, Homo sapiens
tgtggactttggtcagtgtacagacacaggtgaatgctgctaaagacaaaactggagctgctcccaccattgatgtggtgtgatcaggctactacaaagttctggagttctgggaaacggaaatctaccaaagcaacctgtcatcatgaaggccaaattcttcagcagaagagctgaggagaggattaagggtgttggaggtggggcttgagtcctggtggtatgaaaccacatggatggaggtttgttaaatgctaacaactgct

SEQ ID NO: 7675 - DNA, 543 bp, Homo sapiens
ggtcgacatttatttgtccattagcatgttaattatttttttttttgagacggtgtttcactctgtcgcccaggctggagcgcagtggcacaatctcagctcacggcaacctctgcctcccaggttcaaagcaattctccctgcctcagctacttgagaggctgaggcaggagaatcgcgtgaactcgggaggtggaggttgcagtgagcggagattgcaccattgcactacagcttggaaactctgtttcaaaaaaaaaaagaagtcatctagctgttttgtttcctttaccactgttcaaaaaacattaaagaggaaggtgtaatttagcctcaaccatcttggagaccaaagactttcagaagaaacaggtccaagttataatgtgggctttcttagcagtcacagattttgtacacattgcctaattttaacaatttcaatgaatgagtgacctctattctggactgattaattgagaggccaacagattattagcatttcacaaaaagaaagacaaaggaaacccatgaaattagcat

SEQ ID NO: 7676 - DNA, 427 bp, Homo sapiens
agctgggcatggtggcgcacctgctaatcccagctacttgagaggctgaggcaggagaatcgcgtgaactcgggaggtggaggttgcagtgagcggagattgcaccattgcactacagcttggaaactctgtttcaaaaaaaaaaagaagtcatctagctgttttgtttcctttaccactgttcaaaaaacattaaagaggaaggtgtaatttagcctcaaccatcttggagaccaaagactttcagaagaaacaggtccaagttataatgtgggctttcttagcagtcacagattttgtacacattgcctaattttaacaatttcaatgaatgagtgacctctattctggactgattaattgagaggccaacagattattagcatttcacaaaaagaaagacaaaggaaacccatgaaattagcat

SEQ ID NO: 7677 - DNA, 250 bp, Homo sapiens
cttgacttctatcatctatcaaatattcatgtaacagatgtgaatgtattttatgtgtcagggactgtgctgggcactagtgtgagaaaaacacatttcctgctttcacagtaatcacagggatatagatgttcatcagttaattacactaatgaatgtagattactgatgtctgttgatgaaatgagcatagaaggatagaaatcaggatggcagaatagttacccactattaagagtggaaaggatta

SEQ ID NO: 7678 - DNA, 357 bp, Homo sapiens
ggagcctcagtttcaccatctgtaaagtgagattaatgaaagggacccacagagggctgttagagccagtaggcggccaggcgcggtggctcacgcctgtaatcccagcactttgggaggctgaggtgggcggatcacgaggtcaggagatcgagaccatcctggctaacacggagaaaccccgtctctactaaaaatacaaaaaattagcctggcgtggtggcgggcacctgtagtcccagctactggggaggctgaggcaggagaatggcgtgaacccgggaggcggagcttgcagtgagccaagattgtgccactgctctctagcctgggcaacagagcaagactccatctcaa

SEQ ID NO: 7679 - DNA, 656 bp, Homo sapiens
aggatgagcagggcttccttcaactcagggttcctgtgaaattaaaaagaattctcatcttgactcaggattgttgaacactattgatatttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggatagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagc

SEQ ID NO: 7680 - DNA, 358 bp, Homo sapiens
ctggcagggaaaagtcatattctaaagggtgctacactcagactgctcaccaagtgctcctcagcccttgaatcactttgaagaaatcaaaacgagatcgcagcgggatgctgcgatgtggctgatgtcagacggtcagcacagacctccctgaccccgtgtcggctgagcggaagtgctgagagccagcaaggatgggtcgttcggatttgggaaaaattagcatgcattgtgcagtcctggggaaacatcatctatgggacaactggctctgcgagttacttacattgaaatgtatggcatgtatgtatcatttggaaagattcttcgccttaatggacttttttgatgaaccact

SEQ ID NO: 7681 - DNA, 233 bp, Homo sapiens
ctgttgaaagaagagaaatacccagaaagcatgaataatgatttaggcaagattaattaattaattaaggtcatttccacatttgattattttaagacattctcccttgactaggaggagttggtgaagcacagtaaatgaaaatactttttttctgcattttcgcttttttccacaagggatccaggtacacctaaactgtttagattttgctatctctaaacagaacagcc

SEQ ID NO: 7682 - DNA, 704 bp, Homo sapiens
tgagacagagtcttgctatgtcagccaggttggagtgcagtggtgtgatcttggcttgctgcaacctccaccttctgggttcaagcagttctcctgcctcagcctcccaagttgctgggattactagcgtgcgccaccatgcccggctgttttgtatttttagtagagatggggtttcaccatgtgggccaggctggtttccaactcctgacctccagtgacccaccctcctcagcctcccaaagtgctgggattacagggatgagccaccatgcctggccaagccaatactttttaattcaagtacaaatcaaactacatcactgagaggaatgttccccaatccagttacactaccctactatccattatcactgttgctgtgaataattagtacccccttccagggagtggggggtacagaccacgtgacagtgggtgtcactgtggtgacaagactgtttgagagtgggaggtgggagcaatcatttatgctggtaatttgccttaagatgttattcccaaacatccttccatgatcctttggattgagataccttaatcccaactgccttcatgtccaaggtcaccacacacacacacacacacacacacacacacacacacacacacacacatcttccttccatgatcctttggattgagataccttaatcccaactgccatcatgtccaaggtcaac

SEQ ID NO: 7683 - DNA, 651 bp, Homo sapiens
ttgcgatggagtcttgctctgttgcccaggctggagcgtagtcattagatcttggctcactgcaacctctgcttcctgggttcaagcgattctcctgcctcagcctcccaagtagctgggattataggtgtgagccaccacgcctggctaatttttgtattttcagtagagatggggcttcatcatgttggccaggtggtcctgaactcctgacctcaagtaatctgcctgccttggccttccaaaatgcttgggattacaggcgtgagccactgcgcctggtccctattttctttttacaacagaccttgggaaatattttcttcccccaagaggttgaggcccatggaatgcattaggggcaggtggggtggtggtgctctgtagcctttaggacttctagaatcaggcttctgggccaccttcttagcaggtgtatacctctttgttccagactgactttctgtctcacaatatcttcactatttccacagttgcagccaagacaggaaactgaaagctgaggccagaagggtggtgtactggggggaggggaaaattgagtgtcactttggaaaactggggcccccatctaaggattgctgcctctgtagattcaaaagcaataaaacagcagctcattaactctta

SEQ ID NO: 7684 - DNA, 633 bp, Homo sapiens
  misc_feature (569)..(569): n is a, c, g, or t
ttgcgatggagtcttgctctgttgcccaggctggagcgtagtcattagatcttggctcactgcaacctctgcttcctgggttcaagcgattctcctgcctcagcctcccaagtagctgggattataggtgtgagccaccacgcctggctaatttttgtattttcagtagagatggggcttcatcatgttggccaggtggtcctgaactcctgacctcaagtaatctgcctgccttggccttccaaaatgcttgggattacaggcgtgagccactgcgcctggtccctattttctttttacaacagaccttgggaaatattttcttcccccaagaggttgaggcccatggaatgcattaggggcaggtggggtggtggtgctctgtagcctttaggacttctagaatcaggcttctgggccaccttcttagcaggtgtatacctctttgttccagactgactttctgtctcacaatatcttcactatttccacagttgcagccaagacaggaaactgaaagctgaggccagaagggtggtgtactggggggaggggaaaatatttgtgtntttatttaaaatatgagtccttatattaaagtttttgtgattatgtatatttttaggtttttaa

SEQ ID NO: 7685 - DNA, 551 bp, Homo sapiens
aatgtacttggctcagtgtggcaaaagcactgggctagcagcagtcagatgtgggttcaaagcaaggcacaatcatttattagctataaatttgggcaagtcacttcttgagaataagtttcttcatctgtaaacagaagtaataccttccttatatcttaaattggtgtggaagtaaatgagtaaaaacctcagggtttttctgagtttaaatgagacaattcatgtaacgtgcttagcacaatacctggtacccagtaggtactctgcagtatttattgatgatgatgatgatgatgatgatgatgatgatgacaaagaaatacaaggaaatgtcaacaccttaacagtgcattcatagatctacaaaatgcttaatctcagtgttctggcaaccactaaatacataaagataatctaagacatcaagatttcaacatataaaaataaatataaaaacaagtgaacaataatcatttatatgtagtttcatgactggaaaaaataataacctagattttttcttaacctagaaaatctagattaaaaaa

SEQ ID NO: 7686 - DNA, 359 bp, Homo sapiens
atcactatcatttatctatcattgaacacttctcactttcttaagtcagggtggaaatggcatagaaaattggttgatattggccaggcgcagtggctcacgcctgtaatcccagcactatgggaggccgaggtgggcagatcacaaggtcaggagatctagaccatcctggctaacacggtgaaaccccgtctctactaaacaaaatacaaaaaattagccgggtatggtggcaggcacctgtagtcccagctacttgggaggctgaggcaggagaatggcgtgaatccagaaggtggagcttgcagtgagctgagatggcgccactgcactccagcctgggtgagactctgtctcca

SEQ ID NO: 7687 - DNA, 425 bp, Homo sapiens
acagccaacatcagcattgtccttgcctgaatggatcattcaagtctgcagaagttttgttttattgtctcttcatacatgtctgtagtggatactctgggtataacccaactctcatttcaaggaaagacttggtgtcccagttgctgggagtgctgacagtagacagctttcagatgtcagcacttcagggaattgtctcagcttcagaaagccactttccgcgaggttatgtccttcctgggatggctcacgtgcagtctagacaactctggatggccattctaactcaagaactgcccaggctgacactgatattgggactgcaggtagcttcacttcctactctgcccaatcctgctttcttcccttcccttccacaagtgttagtggatgctcaactgtgtgctcaactgttttcaaat

SEQ ID NO: 7688 - DNA, 315 bp, Homo sapiens
ctgaagcagagaattgagatgcctcagctatcaagttgttacatatagaagtgttcctgtggttgatgagttactagaattattgacccatttctggacttttcatttaaaaagttgtaagtagggaattttggagatcatgagttatatttattttatccctgtatcttcagcccttattagcatggaacctggcacatagtaattgatatgtattatctattacagcaacctataaaagtaagtatttgtcttgttttatggatgagcattctgagacttcaaggggttaaatagcttgctagtaagtggtgg

SEQ ID NO: 7689 - DNA, 825 bp, Homo sapiens
ctgtagtgctattccctaatgagcaactaagagaagacacaacaataaaccatggaagtgttgggaggccatggaaatgatttagaggtataaaatattcccaagtttttattataaatttttattcataggttaaaacatataagcataagtgattgtacaggtgtgactcccttttctaggagagaaaatagctttatttgaaaactccaaaagctacttaatcttaccagaggtttttaataggggaactgggtttacttacaatgaaagcatattttcattctgctatagaaaaacatatccctgctcattcagtaaatctaagattggaatgctttctagaactatgcaatatttgaataatttctagaaatgtctaagaaacaaccttttttattttaaatcatcacttacaaacgtagtctgagactgcaaactagttttcacttgactaatccattcattatagattagttaccatttgctctatataatctattgaagaaactattgttattcatattttgattaattttactagcaacaaatttttattttagtagcattgcatttaccttaaatatgtaaaaatgaagttgtaacaggatcaaatatggaaatggcaatggtaactctgcctagaacatagttgaatgtccttggttgtcggtaagatgcaaagatctatacaaattttatcataggtcaaaattatttctaaatatacaaacagtttcaactatttctttctccctaaaactaaaaccaaaccaaacccaaatgaagaaacctaaacttcttttcatctaatagttataccca

SEQ ID NO: 7690 - DNA, 468 bp, Homo sapiens
aacacgattgctccttgccagtgcaggatagcagaccccagccttcactagaaaactcagactctgtcgtttagcataagtcccttcacagcctagacctgtccaccttttccaaccttttctcccaaattctgagcaagaaccctctgctttattcaggcagtgctctctattgaccacacatttgatatgcccatcctcacctgtgtactttgttctgtgtttctcctgcttattattaacataggagcaaggctcaatgcctataatcccagcactttgggaggcctaggcaggcagatcacctgaggggagctcgagccagcctgaccaacatggggttttaccatgttggccaggctggtcttgaacttctgacctcaagtgatccacctgctccgcctcccaaagtgtttgggattacaggcttgagccaccatgcctggcctacactgtgttaattttctt

SEQ ID NO: 7691 - DNA, 1341 bp, Homo sapiens
gcgcgcggcggcgacggcgcgccgtaggtgtcatgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctgg

SEQ ID NO: 7692 - DNA, 806 bp, Homo sapiens
gcgcgcggcggcgacggcgcgccgtaggtgtcatgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctggtaacaagttcacagtgtgaacctggaccctgagacccacccagggcttcgtagggtagaccctttaccaaattccgacaaggccctgggggctggtcctttgcctgtctggcccccagggattcacctcctctcaagtcactaacgtgctaaactctttccttgtctggcccggctacttgcagctctctctcctaggaacactgtgctggatggctggtttctcctttggtttcaggacagatgtcaccttcattgactgcccagctctcttattttctatgacagcagctgg

SEQ ID NO: 7693 - DNA, 604 bp, Homo sapiens
gcgcgcggcggcgacggcgcgccgtaggtgtcatgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctggtaacaagttcacagtgtgaacctggaccctgatatgaatccgacaggctggggctggatcgtgctaactctttcttgtctgcccgcacaacc

SEQ ID NO: 7694 - DNA, 1117 bp, Homo sapiens
agagcctggtaataaaaggcatgtgaccatgggggaggttcactaatcctggggctgctgcaagcttccctcgagtcctgtgagcgtcaacacaaagcatttggcatggagcctggttgtggcacactctcagtagctgtgctgctgctccggtaatgcagacgcctctggtggagggctgtgctgtggtgctgtctgctatgtgtcagatgtggtgtcctcaggaaagcagggcttttgcctgagccccgcaggcagtgacagggtggtttttgcctttgattcagaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctgg

SEQ ID NO: 7695 - DNA, 470 bp, Homo sapiens
tgtgaatggttgggaacatttttcatcttcagctggtttcatggtgcgattatccttcctgctttttgtgagatatatttctgtaagggactcagagttggctttgtctgcaccaattcaagtggctaaatataggaatggtcacttgattccacttaacaaatccctgagagtttttcatttgatctttcaaggtggctttgagataaacctggaccacaggaagctgaaaactccccaagccaagctctttaccgtccccagcgaggccctggccattgcagtggctactgagtgggattcccagcaggataccatcaagtactacaccatgcacctggtaacaagttcacagtgtgaacctggaccctgagacccacccagggcttcgtagggtagaccctttaccaaattccgacaaggccctgggggctggtcctttgcctgtctggcccccagggattcacctc

SEQ ID NO: 7696 - DNA, 1868 bp, Homo sapiens
gcgcgcggcggcgacggcgcgccgtaggtgtcatgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaagaccacattgtgcaacacatcattggacaacccaacccagagaaacaaggatcagctgatccgggcagccgtgaagtttctggacaccgacaccatctgcttacagggtgggaggagcccgagacattagtgggaatttcaaaggaatgagtgggatccaattcattcgaatggggttgagaaaagggattgagtttgtagctgcccagctcaagtccatggtgctaaccttgggcctgattgacctgcgcctgacagtggagcaggccgtgctgctgtcacgcctggaggaggagtaccagggaggatttccatgtcagctagaaaagttcatccagcctgctaggatggcttgggattgactcaccctgtctattaaacgtgtacaccaagagttgattctggtcaccagctcatcttctcgattgtcaatcttcaggaggtggatgtcgtgcgatgccccgacagcattaacaatcgtatctttatcgacaaaaagctggtgagtgaaaagaatccaatgagaaagtgtgtgtcattataccgtgaacacaaagggagctgaacagagaaggagcatttggaagtcccctggctgtgcaggccacactcagagcagagcccacctttgtatcagcgcactctgccgattcatctgtgaattcatctgtgacagccgcttccccaactgcacagggcaggtgttgtggggaaagggccaaccagggtgttactttgcagtccccgctggaagcatgtttcctccagggtgaaggcagatggctgcccagggggcacctcacccaggacatctgttctcacaatgcttctctctcaattactctcaagtctaacttgcccaaaacctctgcctgctgggtggaagcatgaggctggctgagggtctcgaggctgctctgaagacagcaggccctacaaactcatgggtgttcaccccacagttgtctctccactgccactcatgtcaacaaaaccaaactttggattccatttggagtatccttctgccttctcttgttcctgactttgctgtcttgtaaaaagttgttagaaacaaccaccttctaataggcctcactggttctaggtgttgacactgtggctattgttgcctgggatggttgaaatggagtcatttcccagagcagggcaaggccactgaagcactcagtaagcagttgcttccaccttgaagcagaggcgcttggtaaggcagagcacctgaatgctctgtattgcagggaggatttgcaagtggagtgtgcattttttgttctttcctgtagtggcagttaacttaatggtctctaaaacgttctgtgcaatcttaagatgttaatatttctgccaaaaaaagtattctttggtcaaatacatttgggaaagccagcacatcctaggcccctcctaaagatttgctgggcacaaagtattctgaaggctctacaaagtcctgtggaaaataaaccctttaagctttgtc

SEQ ID NO: 7697 - DNA, 1554 bp, Homo sapiens
gcgcgcggcggcgacggcgcgccgtaggtgtcatgcggaagatggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgccctgaacaagtgggaagcaagtgcacctgaacatgcgcacatcaacagacctggacacgcaggaaagaaaccacagaatccacagacaagattcgggccaaaacacatatgacgatgcgagcacctacatgaccataaatggaagaccatcgccacaacgaagccatggcagggagcacacaacaagaccgacacagacagggaccagaccccttcacgaacacatccccaaaatacataccatcagacatcccaggagaaaagacaacacaaacaagagaccagaagcccacgacaggccatcgcccctggaaacacggcaaatgcagaggaccaagagagccaaaaaaaccaacaaaacagtcaaacccagacaaaatgaaaggtgcaacgagagacaacaccaccaccagagagtgcccccacggggaagacagatccaagagggaacgaacacacaaaagagaccgattgagtgaggaaaacaggcgcgatacacactaggaggaaagtagaagggagacgcaaaccgggacgccgaggatagaaggaatcagaagaccaagaaaagaaaatgtcacccgcaccaggagagagaacgacaacagggaggcggaacaatacgaaaaaacagagatgagaaaagaagggaacaaaacacaaaaaccgaagacactaaacagaac

SEQ ID NO: 7698 - DNA, 1436 bp, Homo sapiens
gcgcaggaggcgcgcggcggcgacggcgcgccgtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgccctgaacaagtgggaagcaagtgcacctgaacatgcgcacatcaacagacctggacacgcaggaaagaaaccacagaatccacagacaagattcgggccaaaacacatatgacgatgcgagcacctacatgaccataaatggaagaccatcgccacaacgaagccatggcagggagcacacaacaagaccgacacagacagggaccagaccccttcacgaacacatccccaaaatacataccatcagacatcccaggagaaaagacaacacaaacaagagaccagaagcccacgacaggccatcgcccctggaaacacggcaaatgcagaggaccaagagagccaaaaaaaccaacaaaacagtcaaacccagacaaaatgaaaggtgcaacgagagacaacaccaccaccagagagtgcccccacggggaagacagatccaagagggaacgaacacacaaaagagaccgattgagtgaggaaaacaggcgcgatacacactaggaggaaagtagaagggagacgcaaaccgggacgccgaggatagaaggaatcagaagaccaagaaaagaaaatgtcacccgcaccaggagagagaacgacaacagggaggcggaacaatacgaaaaaacagagatgagaaaagaagggaacaaaacacaaaaaccgaagacactaaacagaac

SEQ ID NO: 7699 - DNA, 1491 bp, Homo sapiens
gacaacatagtgagacatggtctctgcaaaaaaatagaaaaatcagcagggtgtggtggcatgcacgtatactcccagctactcaggaagttgagtgagaggattgcctgagcccaggagtacaagactgctgtgagctatgatcatgccactatactccagcctgcgcaacacagtgagaccctgtctggaggggtggggggagaaaaaaaacaccatagaaacatcccaaatgtccaataacaaattgtagtccatccatacaatggactactactcagccatgaaaaggaatacagcactcacatatgctacatgtgaatgaaccctggaagcattatgctcagtgtaagaacccagacataaaaggtcacacattttatgattccacctatatgaaatatccagaagaggtaaacctataaaaataaaatgtatatttatagctgccgggggcttcagggtgaaggcataggaagaaactgtttaatgggtacggagttttatcttgcagcggtggaaatgttttggaactaaagtcgtggttctacaacattgcaaatgcactcgatgccactgaactgttcactttaagatggttcgttatgtaaatttcatcttaataaatgcatgaagaaagggatttgtatgtatcaactacagtgtctcatgaagcaaagattataattattccatttacctggtgtttccctatccaataattcccatttcctccaaaaaaacaaataataggaacctcatgggttgaaagagagcccataatgaagattagaaaatacactcctatagatgaatagcaaaggccgggcacagtggctcacgcctgtaatcccagcactttgggaagtcaaggtgggcggatcacgaggtcaggagatcgagaccatcctggccaacatggtgaaaccccgtctctactaaaaatacaaaaattagctgggtgtggtggcacatgcctgtaatcccagctactcgggaggctgagacatgccagcactccagcctggcaacagagtgagattttgtctccaaaaaaaaaaaaaaaaaaaaaaagatgaatagcaaaaaacaaacaaaaaaaaaaaaacaaaaaacatattttggggccgccctagggccccgtaaaagaaagttctcttacacaaccctttttgtgtgtgggaggccccggcgttccccatatgtgctgtaatctgacacaatgtgtgtgctaagacacgcttgttctccctagagacaacctggtggatataaaaaaatagggacgtaggcagcgtattcctcccacccaaatgttaaaaaaaccgccgccgggtggagtaagacaacccaaaaggcgtcttagtgaaaacaactctcctccacatgtagtaggtttcgcagagagacataacatcacgggggactgcttatcacaacaaggcggatgtccacaagaagacattgagaatatatacaattattgcgccg

SEQ ID NO: 7700 - DNA, 1049 bp, Homo sapiens
agcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggtgggcactaagatggccaggagggtgggtcactttgtccacctcagactcagcaaggctcaagagcaaagctgatggatgcactgacatttccaggggaagctctgtagaatctgggactcttccctgcccctctgggaactttactctccagcaagactgaagaagctccttggttagaattctaatttggcccagggaaagggcaacctcccacattttctcccaatcctgtctcttttccagacacggaaggtgctggccgcacctgctgactcactcttgggctgataaggcacatatgggttggtgagggtcatcttagccatttttctgcctttgctgaggattctaggatcctgtgccccgagatggctgctcatacctgggagatgggtcaaatcttttcctgctttcagcctcaccatcatccttttccatgcacttgcccctgtccaataggagaatcacttgcgttccttcccacagttccatggggcttgggccggcagactgcatacctgagctgtcatctcaagagtgctgtgttatcttaggacggttgcttaccttctctgggccttggcttccccatgctcctcccactccccatctccaagccctaacttatttaaatggaaaaggatccc

SEQ ID NO: 7701 - DNA, 725 bp, Homo sapiens
tgttataagcgtgttgatggccctgtctgctgctagtggtcttttgctccacgtgatattgactatgatcatctggagggtccgtggttccagtgacttagcatcaaagacggcctaacacacacgtctggtgcctctgctgggatggctgaagcagccggaggctggccaggtatctctctcctcatggtcccccatcaaggtagcctggtcactttacacagtggtgcagggttccaaaatagagcattcaaagaggacaatacccaatgtgcaagggtttgtcttcttgcatcatgctccacaggccaagataaatcacatgtccgagcccaagggcaaggtgggaagggaccatacaaaagcatggatactgggaggcataggtcattgcggaccgcccacgtaagcctaccacaatcttttgtccattttcaaatgcattgtcttttccaaattgctttagctcttttttatttatttatttttttttttgagacaaagtttctgtcttgttgcctaggctagagtgcaatggctcaatctcaactcactgcaacctctgcctccggggttcaagcgattctcttgccttggcctcccgagcagctgggattacagaagcccgcctccacgggcggctaatttttgtattttttagtagagacagggtttcaccgcattggccaggatggtcttgaactcctgacctcaggtgatccacc

SEQ ID NO: 7702 - DNA, 117 bp, Homo sapiens
aattcaagcttctaacgatgtacggggcatgagccactgcacccagccctgtattcttattcttcagatatttatttttcttttcactgttttaaaataaaaccaaagtattgataa

SEQ ID NO: 7703 - DNA, 1875 bp, Homo sapiens
agcgtccggcggtcgcagagccaggaggcggaggcgcgcgggccagcctgggccccagcccacaccttcaccaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7704 - DNA, 2677 bp, Homo sapiens
agcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataaaaaaaaaaaaaaaaaaaaaaaaaaaaaaaaaaaaaaaaaaaaaaaaaaaaaaaggagggggggcgcgcgccaaaaaaatctccccccggggggcccacaataagcacccacccatcatgtttttgtaacacaacagggggcccccaatatagagggtgctctctatataaacaagacatgaccagcggacgcgcgtattaaacacagctgttgagagagagcaacaacatggtgtaatgagaaatattcttgtgagacgcaacccaatatcggggggaggagcaaacaaatatatgggacacaacacacctccacaagagataattataccagccgcgcgaggagacatacacattcaaccttgagatgtgtttatatcgtggttgaaacacaacagctgcataatatgcaggtctcgatcagaaaaaaaaattacacgcacagataatattataactaagaaaattttatacagcg

SEQ ID NO: 7705 - DNA, 2047 bp, Homo sapiens
gctgggaagtgaccacggatagagaagagacaaagtcacagaaaccaagagagataggatttcactgtgttgtccaagctggagtgcagtggctcaatcacaggtcatggcagcctcgacctcctggggttcaggtgatcctcccatctcagcctcccgagtagctggggctacaggtcttttgctccacgtgatattgactatgatcatctggagggtccgtggttccagtgacttagcatcaaagacggcctaacacacacgtctggtgcctctgctgggatggctgaagcagccggaggctggccagcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7706 - DNA, 2285 bp, Homo sapiens
cacagtctcactctcctgcagccgcccaagtcgatcacctctcacctggattcctgctgtggcctcctcactgtgggtgctccatgcatctgccccttgccctgcttcccagggtatttttaaggtagacccataggatatgcggatgaactggatcagcatgggaaaggaagtcagcggggactgccaggtttggggcccaaactccaggaaggatagagttgccgttttctgagaactgtagggggaataagtgaggggggtcaggaattcggttcagggagtgttttggttcagggtagtgatgttgagtagccgtgagatccttgactctggtgttcaggcagagatctgggccacagatataaacttgagaatcatgaactagacgttgacatttaaagccaccaggctggatgggatcacctagagattctcccacagtcacttgcacagactccctggcccatgttaacctccgaggccacattccttcaaagtatccccagtcccccacttaccctttccttctctccttttctcaccagcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7707 - DNA, 1783 bp, Homo sapiens
  misc_feature (1562)..(1562): n is a, c, g, or t
agcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatcagctaggcgcgagaggccatgggcggtgacccgnctcgccgaagagccggcggagcggcgcaggccctaaccgggcggtccgctgaccagccgctggagcgcggcggagattgtgggccaacccaggggggccggcgcggggagacagggtcagctgggcccccaaaagggcattcccacccccgtttttttggcgccccgggggcgcaggccagccccctccacttggtggcccgatttttcttgtattactat

SEQ ID NO: 7708 - DNA, 542 bp, Homo sapiens
aagctgtacggccggaatctaggatgcggcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7709 - DNA, 2200 bp, Homo sapiens
agcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7710 - DNA, 2190 bp, Homo sapiens
agggctgtacgcccggaagttcgggatgcgcgggccagcctgggcccagcccacaccttcaccaggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7711 - DNA, 1832 bp, Homo sapiens
taccggtgttatcgatgcacccccccgatcagatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7712 - DNA, 2626 bp, Homo sapiens
agctgacatgccctgtaggggagcgggagggagggacacaccatcaacaagtaaatcagtgagaggatgaaagatggcgatgggtgccgggaaggaacaaggagacagcgactggagagggtggtcaggagttgccagtggagggaagacctgaagggtgagagggacggggaaagacaccctaggaagagggagcagcgtcacaaaggccctgagaggctgaaaggtttgggcgggttccaggaacacaggcggccagggaggtggagcccacacctcaacacacaactacccgtgaagaacgtggagcgatccgtgtagatccttgtagaaggttctctcagagggccatgtcactgacctgtcagtcagcccacagcctcctcccagtccccagatagctgaccactccctccttgaaattctctcctctctcagcttgtgcaacaccaacctccggtggcaggaaaaactattattattctcttgtgaaaattaaaacttaaccatcaacatagagctgttactggtttgaaggaagccattgacgctgtgtcaaaggctagagcagaaaacagtggcatgcagtgtcaaaggtcaaagtcaacacttctcggactggcacagggaagataggatttcactgtgttgtccaagctggagtgcagtggctcaatcacaggtcatggcagcctcgacctcctggggttcaggtgatcctcccatctcagcctcccgagtagctggggctacaggtcttttgctccacgtgatattgactatgatcatctggagggtccgtggttccagtgacttagcatcaaagacggcctaacacacacgtctggtgcctctgctgggatggctgaagcagccggaggctggccagcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7713 - DNA, 1897 bp, Homo sapiens
agcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggctggcaggctgggaaccacagcgccttctggggcatgaccctggatgagggcattcgctaccgcctgggcaccatccgcccatcttcctcggtcatgaacatgcatgaaatttatacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccacccctgtattcttattcttcagatatttatttttcttttcactgttttaaaataaaaccaaagtattgataa

SEQ ID NO: 7714 - DNA, 2085 bp, Homo sapiens
agcgtccggcggtcgcagagccaggaggcggaggcgcgcgggccagcctgggccccagcccacaccttcaccagggcccaggagccaccatgtggcgatgtccactggggctactgctgttgctgccgctggctggccacttggctctgggtgcccagcagggtcgtgggcgccgggagctagcaccgggtctgcacctgcggggcatccgggacgcgggaggccggtactgccaggagcaggacctgtgctgccgcggccgtgccgacgactgtgccctgccctacctgggcgccatctgttactgtgacctcttctgcaaccgcacggtctccgactgctgccctgacttctgggacttctgcctcggcgtgccacccccttttcccccgatccaaggatgtatgcatggaggtcgtatctatccagtcttgggaacgtactgggacaactgtaaccgttgcacctgccaggagaacaggcagtggcagtgtgaccaagaaccatgcctggtggatccagacatgatcaaagccatcaaccagggcaactatggacagtgctgaacccaggggaggtgcttcccacagccttcgaggcctctgagaagtggcccaacctgattcatgagcctcttgaccaaggcaactgtgcaggctcctgggccttctccacagcagctgtggcatccgatcgtgtctcaatccattctctgggacacatgacgcctgtcctgtcgccccagaacctgctgtcttgtgacacccaccagcagcagggctgccgcggtgggcgtctcgatggtgcctggtggttcctgcgtcgccgaggggtggtgtctgaccactgctaccccttctcgggccgtgaacgagacgaggctggccctgcgcccccctgtatgatgcacagccgagccatgggtcggggcaagcgccaggccactgcccactgccccaacagctatgttaataacaatgacatctaccaggtcactcctgtctaccgcctcggctccaacgacaaggagatcatgaaggagctgatggagaatggccctgtccaagccctcatggaggtgcatgaggacttcttcctatacaagggaggcatctacagccacacgccagtgagccttgggaggccagagagataccgccggcatgggacccactcagtcaagatcacaggatggggagaggagacgctgccagatggaaggacgctcaaatactggactgcggccaactcctggggcccagcctggggcgagaggggccacttccgcatcgtgcgcggcgtcaatgagtgcgacatcgagagcttcgtgctgggcgtctggggccgcgtgggcatggaggacatgggtcatcactgaggctgcgggcaccacgcggggtccggcctgggatccaggctaagggccggcggaagaggccccaatggggcggtgaccccagcctcgcccgacagagcccggggcgcaggcgggcgccagggcgctaatcccggcgcgggttccgctgacgcagcgccccgcctgggagccgcgggcaggcgagactggcggagcccccagacctcccagtggggacggggcagggcctggcctgggaagagcacagctgcagatcccaggcctctggcgcccccactcaagactaccaaagccaggacacctcaagtctccagccccactaccccaccccactcctgtattcttttttttttttttttagacagggtcttgctccgttgcccaggttggagtgcagtggcccatcagggctcactgtaacctccgactcctgggttcaagtgaccctcccacctcagcctctcaagtagctgggactacaggtgcaccaccacacctggctaatttttgtattttttgtaaagaggggggtctcactgtgttgcccaggctggtctcgaactcctgggctcaagcggtccacctgcctccgcctcccaaagtgctgggattgcaggcatgagccactgcacccagccctgtattcttattcttcagatatttatttttcttttcactgttttaaaataaaaccaaagtattgataa

SEQ ID NO: 7715 - DNA, 245 bp, Homo sapiens
gtgattgaaactgagagggtgagaggaatatgcaaggtcagaaagcaacgggtcacccaaattacatgtgccttcttggctattgcaaggcctctgaggacaatcttttattcatagagaaatggagaaaaactggagaatcgcttgaacctgagaggccaaggttgcagtgagctgagatcgtgacattgcactttagcctcctggagacagagcgagactccctccctccccccaaaaaaaaa

SEQ ID NO: 7716 - DNA, 428 bp, Homo sapiens
cattcaatcacacaaaatagaattaacattacattaatattgattgatttaattttagcatatttatgatgtttgttaatggtatattaatacttaaccagtcctctattttatttgctttccatcttttgctatttgaaaccatactgaccaggcacagtggctcatgcctgtaatcccagcactttgggaggtcgaggtgggcagctcacctgaggtccggggtttaagaccagcctggcccacatggtgaaaccccatctgtactaaaaatacaaaaattagctggacgtggtggtgcatgcctgtagtcccagctactgaggaggctgaggcaggagaattgcttgaatccaggagatggaggttgcagtgagctgagatcacaccactgcactccaggctgggtgacagagtgagactccaac

SEQ ID NO: 7717 - DNA, 5304 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagttggagttgtatgatcttcagatcttaggcacaaaaccaccgatgaattccgatacacatcgtaactttgaccccaccgcaacccttagaaatcagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaacaagttctgtgcttccggctgcagtgcaggcctgcccacagtaccctgccagcatgtttacgccctgacctggagggaccagctaaggaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 7718 - DNA, 5118 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 7719 - DNA, 3633 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 7720 - DNA, 371 bp, Homo sapiens
  misc_feature (17)..(18): n is a, c, g, or t
tgactctagcaggatcnnagaggtcgtatagaagcttcatgtaggaggtaaaatgtcaagattgaccctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctca

SEQ ID NO: 7721 - DNA, 935 bp, Homo sapiens
  misc_feature (24)..(24): n is a, c, g, or t
  misc_feature (27)..(27): n is a, c, g, or t
  misc_feature (31)..(31): n is a, c, g, or t
  misc_feature (906)..(906): n is a, c, g, or t
  misc_feature (908)..(908): n is a, c, g, or t
gttatgcgtcactgactctcttanttnccancgctacaggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaacccatgcggccgttccttaatgagggttantnatgatctgccactgctcctggctcggg

SEQ ID NO: 7722 - DNA, 206 bp, Homo sapiens
gtgcctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgt

SEQ ID NO: 7723 - DNA, 3946 bp, Homo sapiens
gcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatggggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 7724 - DNA, 3729 bp, Homo sapiens
ggctgggctgcgaatagcgtgttcctctccggcggaacacacacacccggccttggggctgtctcctgaagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggcggcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccaccgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagttggagttgtatgatcttcagatcttaggcacaaaaccaccgatgaattccgatacacatcgtaactttgaccccaccgcaacccttagaaatcagggtgatttcacctggaacagcatgtcaggccgcagtgtgcggctgaggtcagtccccatccagagtctctcagagctggagagggcccggctgcaggaagtgcctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 7725 - DNA, 605 bp, Homo sapiens
agcttatggcaaaagcctgtgggcacctcccagcaacaaccactgggactttggactagagaatttccacttgaagggcatttactgactcgcaatgaaacatttactgaagccaccccactgatacctgaaataggcatgctgtctcagatgatgtcagaggaacattctaatggggatggcagtgcccagaagagttccatgacacaatggaaatggtttatagaggatcatgctactcaaggcatgcagagaatttcttttcccctaggactgactctggaactgtgtgagaaactgctggattctacagtgccaaataaacaactttcaactgaccaaacaagagcttcttggtttatggatggcaattccaaggcacaaaatgctaggaagaactgttctgtttctcagtaagagagacagaaactggctatgggaaagatttcctggtgggaaggccctgaacatagctggcaagtgagactgatgctggcagccctgggggactacaaatggaataggaattcttgataggaatagacactgactctagtgcaggctttgcttatccaatggaagatgaaagtgttcagagtgccata

SEQ ID NO: 7726 - DNA, 342 bp, Homo sapiens
cactgaatgagctgtggacacagactagaccttcctgggaccacataccacctccgattgacggatcccattaacaccagcaggcctcttggggcctgccatcaccaaaggcagctgagtgaggagagcctccccaggcttgaaaacacttgggcttgattttgttaaagctgcacatcgaggcacttccccctgagacctgggttatctcatatcctctccaattcggcaagggcccccgttatgctggattgctttggatcatggaggaaaaacaataatgaagccatattttgggcatctggctgagctttgttcttcctttgagaaaggaagccatac

SEQ ID NO: 7727 - DNA, 425 bp, Homo sapiens
actactgggctcgagcgatccactctcatcagtctcccaaagtgctaggattacaggggtaagccactgctcccggtctgttttttgataacttacataaaataatagatcatttaatgggcttcttgatttttttcaagttgtctttgttgcaacaattgtttgtttgtttgttttttgagacaggatctcactcggtctcccagtatggagtgcggtggcacgatctcagctcactgcaacctctgcttcctgggctcaagctatcccccccacctcagcctcctgagtagctgtatttacaggcatgtgccatcatgcctggctaattttttccttttttttcttttcttttttttttttttttttttggtagggacagggttttgcatgtaacccagggtggtctcaaagcccaggtggac

SEQ ID NO: 7728 - DNA, 1164 bp, Homo sapiens
accacgcctcgccgatctttttgctttgttttgtttttagctgctgtgtccccaacacctggaagaactgagcttctggaatctaatagatgctaaataaatatttgttgcatgaatgatagtggtatgagaggaagagggaaaaaaaacggaaaaaggcttcttggaagaggtgacacttgaggatatatttccaattaaatatacctaagtgactgcccacctctgcaacccaatgtcacattcgagtcttactgaactacttgactgcatttcccgagatctcacctcttctcgcctgtaccctgtgcgcggaaagtcagccctccaccttctccctgcttccactcccaaaatacttcgtggttttgcagctctggagtatttaccgtgttggctgtttaaatttctgcctccatcagaaggcagaaactgactcgcgaactattccatccccagccgatagtagacgcttaaaaaagaacgaaagaaggtgggtggaggacttcagtaacatcaggtggcagcctcaattttatcgtttgtgaaacgtggatagtaatccctctatcacgtggctgttgcaggaataaagtgaaaaaacaaaacaggctagcttgttcaataaatgtgagttgaattaaatctgatttgtggtcagtagaaaaagatgtgaatacttggaaaggaagacacatttttttaaatatatgcctggtaaaacggatcagaaggcaggtccccatggagcacaccctcgccctaaacatgctgaacccgggctgccatagcctgcgtggtccctccaaggtgactgctccgacaaaagggtacgctcttcaaacgcatacgtttaaggcaattccagaaaccctcggctgtgccgcgactacacggccattaaagaaaagacgactctatgcccgccgtaatgttctcagatcacagggaccgtatttggagctgggagggagggaagccttttcttcacggggggctaaggcgtcttcgagcccccttccaatcccgggtccggccgggtaatccctgcccagcgttcgggcgtgcctttttttcagccgagacacaaccctgaacgtggggcccgccagcccggcggctgcctcgtggaagtcacgttccttctgcccgtcctctcgggta

SEQ ID NO: 7729 - DNA, 1096 bp, Homo sapiens
tctctacttccattccttgcccctctgcaacccattctccactccgcagccatttttaaaaagatgcccctccctacttatgactctaaaattgctcttctcactcttcccctcaggatatatttccaattaaatatacctaagtgactgcccacctctgcaacccaatgtcacattcgagtcttactgaactacttgactgcatttcccgagatctcacctcttctcgcctgtaccctgtgcgcggaaagtcagccctccaccttctccctgcttccactcccaaaatacttcgtggttttgcagctctggagtatttaccgtgttggctgtttaaatttctgcctccatcagaaggcagaaactgactcgcgaactattccatccccagccgatagtagacgcttaaaaaagaacgaaagaaggtgggtggaggacttcagtaacatcaggtggcagcctcaattttatcgtttgtgaaacgtggatagtaatccctctatcacgtggctgttgcaggaataaagtgaaaaaacaaaacaggctagcttgttcaataaatgtgagttgaattaaatctgatttgtggtcagtagaaaaagatgtgaatacttggaaaggaagacacatttttttaaatatatgcctggtaaaacggatcagaaggcaggtccccatggagcacaccctcgccctaaacatgctgaacccgggctgccatagcctgcgtggtccctccaaggtgactgctccgacaaaagggtacgctcttcaaacgcatacgtttaaggcaattccagaaaccctcggctgtgccgcgactacacggccattaaagaaaagacgactctatgcccgccgtaatgttctcagatcacagggaccgtatttggagctgggagggagggaagccttttcttcacggggggctaaggcgtcttcgagcccccttccaatcccgggtccggccgggtaatccctgcccagcgttcgggcgtgcctttttttcagccgagacacaaccctgaacgtggggcccgccagcccggcggctgcctcgtggaagtcacgttccttctgcccgtcctctcgggta

SEQ ID NO: 7730 - DNA, 2275 bp, Homo sapiens
  misc_feature (323)..(323): n is a, c, g, or t
cggacgcgtgggtggcaattgtccaagaaaagatttcaggtttgtcaagttttggtatagaactcggtttctttgttgaagaatatgctggaagcaaaggaagatttcctccaactaaaagaagggaaaagaaatcactctatattgccactattgaaaaaggacatagcttggtgaactccttgattgaaactggaagaattgacagtctgggtctggttgttgtagacgagttgcacatgattggtgaaggaagccgtggagctacactggaaatgaccctagcaaaaatcctctacactagcaaaacgactcaaattatnggtatgagtgcaacattaaacaatgttgaagacctacaaaagtttcttcaagcagaatattataccagtcaatttagaccagtatgtacctaaggttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataacttatactttataaatgaaaaaatacatttcagttatacattaaaaaacgaa

SEQ ID NO: 7731 - DNA, 2269 bp, Homo sapiens
  misc_feature (323)..(323): n is a, c, g, or t
  misc_feature (2243)..(2243): n is a, c, g, or t
cggacgcgtgggtggcaattgtccaagaaaagatttcaggtttgtcaagttttggtatagaactcggtttctttgttgaagaatatgctggaagcaaaggaagatttcctccaactaaaagaagggaaaagaaatcactctatattgccactattgaaaaaggacatagcttggtgaactccttgattgaaactggaagaattgacagtctgggtctggttgttgtagacgagttgcacatgattggtgaaggaagccgtggagctacactggaaatgaccctagcaaaaatcctctacactagcaaaacgactcaaattatnggtatgagtgcaacattaaacaatgttgaagacctacaaaagtttcttcaagcagaatattataccagtcaatttagaccagtatgtacctaaggttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataactaacccttacatattggcngcattcttatctgttattctttggga

SEQ ID NO: 7732 - DNA, 206 bp, Homo sapiens
gtaagcaaacaaaccattttttaaccttaataatcttgcgtagtgttatttccttgtattatagacatcagaacaaaaacatttcacattgcataactgtttatttctatagatacaaaagtacatactcttatttgtgagtaaaaataatgcatctgttgtgacacaagccttgcaaaacaaaaaaaggacctgctaaaaaataa

SEQ ID NO: 7733 - DNA, 250 bp, Homo sapiens
ttaaaagttataagcaactctttacaaacaaatttcatatgaatatatgcatgttttatatgagcactatatgaagatttacttctctgtcctttttaaaaaaaatctcgaagttgcacatgattggtgaaggaagccgtggagctacactggaaatgaccctagcaaaaatcctctacactagcagtaagtattttttcaaatgaggtcatgaattgatttataatcaagagacttataaaatacttaa

SEQ ID NO: 7734 - DNA, 519 bp, Homo sapiens
ggtattttgattaaaatgaccagaactctttttattgacttatttttcaattttcaatcttttcctcatcctaaaaccagttcctcaaattcctcagggtcctccccatgtttcttcacatctgttttgcttagaatcatctttcatctctggcttaactcaagttccagaacttatgtaaggaacattctctctgagccccctatcacacaaaccaaactttgaaataacttacaaaatttaaattttatatatttctttgtgttctacaggagcttgaggagttttgggtttacagagcccttttggtagaacttaccaagaagctgacttactgtgtaaaggcagaattaatccctctcatggaagttactggagttttagaggtcagtagcttgttggtttcccaattgaaattatgttgaattaatacagaagccaggttttattattttctgaagtcttaatacagaggaagtgatagcaagagccttaattgctcatttgtcatgggaatct

SEQ ID NO: 7735 - DNA, 496 bp, Homo sapiens
atgtttcttcacatctgttttgcttagaatcatctttcatctctggcttaactcaagttccagaacttatgtaaggaacattctctctgagccccctatcacacaaaccaaactttgaaataacttacaaaatttaaattttatatatttctttgtgttctacaggagcttgaggagttttgggtttacagagcccttttggtagaacttaccaagaagctgacttactgtgtaaaggcagaattaatccctctcatggaagttactggagttttagaggtcagtagcttgttggtttcccaattgaaattatgttgaattaatacagaagccaggttttattattttctgaagtcttaatacagaggaagtgatagcaagagccttaattgctcatttgtcatgggaatcttttatttaaaacaaatagctgttatggccttccagaaatccgctgttactagatggcatacctgatgaaaaatctcagttgtga

SEQ ID NO: 7736 - DNA, 1186 bp, Homo sapiens
tctctgttataaacaaggcgcatggacatctctatgtattttggggtacatatggaaatgtttctctggattagattccccaaaatagttggttcagaaggtatgtacttataaagtgttgatgagtactatcaaaatgacctccaatagttatatagtaagatgttataagagattttgaagactttttgctatatttaagcaatttctacacaatatttaaagccatctctttgcccctctggtaattgtgaaagattgaatatttgtatctttcttttaggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcagtttagccaactcagtccagcagaacaaaatgtagctgccattcttggagtctctgaaagctttattgggaagaaagcatcaggccaagccatcggaaagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggagcttgaggagttttgggtttacagagcccttttggtagaacttaccaagaagctgacttactgtgtaaaggcagaattaatccctctcatggaagttactggagttttagagggtcgagcaaaacagttatacagtgcaggttacaaaagtctaatgcacttagctaatgcaaatcctgaagtgctcgtaaggacaattgatcatttatcaagacgccaagccaagcaaattgtttcatcagcaaagatgctgttgcatgaaaaagcagaagccctgcaagaagaggtagaagagttactaagattgccttctgatttccctggtgctgtggcttcttccactgacaaagcatgaagctatctgatgagaattttcatatatgaattatttattgtacatgtgtgttattaaagataacttatactttataaatgaaaaaatacatttcagttatacattaaaaaacgaa

SEQ ID NO: 7737 - DNA, 1910 bp, Homo sapiens
  misc_feature (323)..(323): n is a, c, g, or t
cggacgcgtgggtggcaattgtccaagaaaagatttcaggtttgtcaagttttggtatagaactcggtttctttgttgaagaatatgctggaagcaaaggaagatttcctccaactaaaagaagggaaaagaaatcactctatattgccactattgaaaaaggacatagcttggtgaactccttgattgaaactggaagaattgacagtctgggtctggttgttgtagacgagttgcacatgattggtgaaggaagccgtggagctacactggaaatgaccctagcaaaaatcctctacactagcaaaacgactcaaattatnggtatgagtgcaacattaaacaatgttgaagacctacaaaagtttcttcaagcagaatattataccagtcaatttagaccagtatgtacctaaggttgagttaaaagaatatctgaaaataaatgatacaatatatgaagttgacagcaaagctgagaatggcatgactttttcacgtcttcttaattataagtattctgataccctaaaaaagatggatcctgatcacttggtagcattggtgacagaagttattcccaattattcctgcttagttttttgtcctagtaagaagaactgtgaaaatgtagcagaaatgatatgcaaatttttaagcaaggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaagagttattttaagagctccctatgttgctaaggaatttttaaagaggaatcaatataaacagatgattggcagagctggtcgtgctggaatagatactattggggagagtatcctcatattgcaagaaaaagacaaacaacaggtattggagttaataactaaaccattggaaaactgttacagccatcttgttcaggaattcaccaagggaatccaaacattatttctctctttgattggtttgaagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggaactatagatttagcttattgtgacattctgtacagagacttgaagaaaggtcttgaaggacttgtgcttgaaagccttcttcatctaatctacctaacaaccccctatgatctggtttcacagtgtaaccctgattggatgatatacttcaggcaggtgagaatataacgtttttcaacttaggctacttcgtttatgaattattacatgctgttttgttttgttttttagagatgaggctttgccatgttgcccaggctggtctcaaactcctaggctcaagcagtcttcccacattgtcctcccaaagtgctaggattacaagtgtaagccactgtacccggcctattatatgctttttatgaagtgattattcactttttttctctattaaaatatatttggaattggatatttttttctttcagtttttaaaaattataatctggcaacagcatttatggttcgtttaactttaatgttacttttctcttaaatataaacatatttgttattgaaaaaagtaaaggttaaaa

SEQ ID NO: 7738 - DNA, 540 bp, Homo sapiens
tatcattatttagcttataatagagtaacattggtagaacaatgaattgatatatgtagaatgcttagaatagtgtctggcacataaaaggtgctcaagagttatcagctataattattatcattgttactatactgagattttggaattttaccttaaaaacaatgtatcacatatgtaaatataaaggtatcttttctatataaaggtatcttttgggtcacatattcctaatgtttattttctcatgattgatagggtaagccaaagtcaaaagtacctgtggggaaggagaaagctagccagtgagcagggagtgaagtaggacccatggggaaatgtgagactttccaaaggctgtggagggaaaggtggctctcagtgccagtcactgtgaacagcagtagaggcatgccagtgttcactggggtctctgcttcagctgctgccatcctgccaggtgatccaacataggatcataagcaacatgggtcatcttttgtttgtttgtttgagacagggccttgctctgtcacccag

SEQ ID NO: 7739 - DNA, 448 bp, Homo sapiens
ggttgatttgaaccgaaagccacacttattataaattgtctaattaaaaaattttaaaatactaaattgcacatataagctacatttaaaaactattctatttgcatcacttttaacaaaacaaagaatttccttagaataattctgatgcagatgagtatatgcatttatggtgcataggggctaaaataactaaaaacattacctgtgtaaagcaaaaggaagctttgatatcaaatgctttttgccagtgtattaagtggaaaatttgctcacagtgggtctgacttaggggcacattttgtcagttgactatgtagatatagttgataaatttagttttctaacataatgctcagagtgaacatttcaaagaaaaacattttggtaatgttatacattagctctgttggccacgtaatttgtgaattataaatcacaattctgt

SEQ ID NO: 7740 - DNA, 454 bp, Homo sapiens
tttttttcctcagatatacattaattatgtttgccttttctctccagttatctgagaagcattttgataatgcaaaggaacctaaacaaatgaaagtgcctgtcggagaaaaattatctcattaatgagaaaatgaataaagctaatgttaccaccatgtgacttttaaatcagatcttcagaattccttttagtgtttttcccatcaccaaacacatgctaagaaaaatatcacagttataatttatgccttatccaacacatgatagattttgtacactatacataatgtacacttaaatactcaagtcattatgacaatgtgctacaaaaacaatcacttgaaaagaatggatatatttatgagcagctcatatccagataatttaggttgtgtgagtgcataccaaaagcagcttattattcttactcctctagtttaaaacagtctact

SEQ ID NO: 7741 - DNA, 1374 bp, Homo sapiens
gccaaaaaaaagagaaaaggaaaaaggctagtaagctgggttaggttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacca

SEQ ID NO: 7742 - DNA, 1508 bp, Homo sapiens
gaggcgagaaaagtagcgagagacgccagcagcagccgccgccgcggagccaacgcggactgggacggcggcggcagtagtgggacccggcgagcgtgagtggcccggagcggccttcgatgcggcgcagtatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggcccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacca

SEQ ID NO: 7743 - DNA, 1655 bp, Homo sapiens
gaggcgagaaaagtagcgagagacgccagcagcagccgccgccgcggagccaacgcggactgggacggcggcggcagtagtgggacccggcgagcgtgagtggcccggagcggccttcgatgcggcgcagtatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcctcctgccgggccctggtacccgaccccccggggccccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacca

SEQ ID NO: 7744 - DNA, 1539 bp, Homo sapiens
tgggcgcttagtggttacgttagccgtgcctgttgggttcgtagcaactttatgaagaggcggcggcgccggcgcccggtcgccccggccacggccgcccggggcggcgactttagggcagaagacggggctgggttggaggcgcgggaggagaaggtggtgtactcgcggtcgcaactgtcgctggctgacagcaccaaggcgctgggcgacgccttcaagctcttcatgccccgcagcacggagttcatgagctcggacgcggagctctggagcttcctctgcagcctcaagcaccagttctccccgcacatcctgcgcagcaaggacgtctacggctactcccctacagcccgcggccaggcgcgccggccggttccgcgcgcagcggccaggaggaggcgccgcggagcccgggcggccgctgcccgcaggaggaagccccggccgccacccccaccgccgccgccccccgaggagagctgcccggccaagcccgtggcccccgggccctgcttcgggggccgcaccttggaggagatctggagggcggccaccccgacgctgaccaccttccccaccatccgcgtcggcagcgacgtgtggggcgagcgcagcctggcggcagcgcggcgcagggcgcgccaggtcctgcgagtgaacctggaacccatggtgaggctccgccgcttcccggtgccccgggcatgaggtgcggcctccagggcgcctcctgccggccccgaccttgggacaggccttccgcccggaggaatgaacaagtgtcagtcgagtgtttacagatccggccaggaccccggcccccaatgcactttacgcgcgaagaagttgccggatggttgtccctgtcccgggccgcggcgcggtcgtcttggacgctggggcaggtgtgccctctgctgcctcccgtacccggcctgcggagggaggggacagctggacccgcaggggaggtccctttcttcctgaccaccgattgagacgtctccaggaccttaggggcagatccgttttctcactgttggactctacctcactggtctggaagtcctccgaagacattatttttccaaaggaatttggtttcgtgcttgtgtaataaagccagaatttacttgttctttatctccccctttttctatttcactgtcacccctctttgtggacagaagttcgaacatgtggtgttgcactagtttgtgctcagggtattctgaagcccactcgtttcctaatttttactggattccaaagctttgatcgaggatattttttaagaggttcaagcttgtgactgttagtagtgcaaggatttgtatgggctcagtgattacaaacaaagacatgcaaaatacaactgtttaaacattttcaaggtatttttaaaggttttgtattgaaacaatgtttatatttactgagctcctaaaaatggtagaatacacatgaaaacttttgtttaggaaaagttaacttgttaaattcttttgaattgaataaaaaaatgcattgaaacca

SEQ ID NO: 7745 - DNA, 1638 bp, Homo sapiens
cggcttcggggaaggtgcggcaggcggtgctgcggcctggcacagcaggtttggggtgcgggaggcgggcggggtaggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatcttgtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctccta

SEQ ID NO: 7746 - DNA, 2939 bp, Homo sapiens
cggcttcggggaaggtgcggcaggcggtgctgcggcctggcacagcaggtttggggtgcgggaggcgggcggggtaggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatctttggcggcctggtcctcctgaaggtgaaggcaaaggtgcgacagtgcctgcaggagcggcggacagtgcccattttgtttgcctctaccgttcggcgccaccccgacaagacggccctgatcttcgagggcacagatacccactggaccttccgccagctggatgagtactcaagcagtgtagccaacttcctgcaggcccggggcctggcctcgggcgatgtggctgccatcttcatggagaaccgcaatgagttcgtgggcctatggctgggcatggccaagctcggtgtggaggcagccctcatcaacaccaacctgcggcgggatgctctgctccactgcctcaccacctcgcgcgcacgggcccttgtctttggcagcgaaatggcctcagccatctgtgaggtccatgccagcctggacccctcgctcagcctcttctgctctggctcctgggagcccggtgcggtgcctccaagcacagaacacctggaccctctgctgaaagatgctcccaagcaccttcccagttgccctgacaagggcttcacagataaactgttctacatctacacatccggcaccacagggctgcccaaggccgccatcgtggtgcacagcaggtattaccgcatggctgccctggtgtactatggattccgcatgcggcccaacgacatcgtctatgactgcctccccctctaccactcagcaggaaacatcgtgggaatcggccagtgcctgctgcatggcatgacggtggtgattcggaagaagttctcagcctcccggttctgggacgattgtatcaagtacaactgcacgattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgggggcctgtggtttcaatagccgcatcctgtccttcgtgtaccccatccggttggtacgtgtcaacgaggacaccatggagctgatccgggggcccgacggcgtctgcattccctgccagccaggtgagccgggccagctggtgggccgcatcatccagaaagaccccctgcgccgcttcgatggctacctcaaccagggcgccaacaacaagaagattgccaaggatgtcttcaagaagggggaccaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctccta

SEQ ID NO: 7747 - DNA, 3194 bp, Homo sapiens
cggcttcggggaaggtgcggcaggcggtgctgcggcctggcacagcaggtttggggtgcgggaggcgggcggggtaggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatctttggcggcctggtcctcctgaaggtgaaggcaaaggtgcgacagtgcctgcaggagcggcggacagtgcccattttgtttgcctctaccgttcggcgccaccccgacaagacggccctgatcttcgagggcacagatacccactggaccttccgccagctggatgagtactcaagcagtgtagccaacttcctgcaggcccggggcctggcctcgggcgatgtggctgccatcttcatggagaaccgcaatgagttcgtgggcctatggctgggcatggccaagctcggtgtggaggcagccctcatcaacaccaacctgcggcgggatgctctgctccactgcctcaccacctcgcgcgcacgggcccttgtctttggcagcgaaatggcctcagccatctgtgaggtccatgccagcctggacccctcgctcagcctcttctgctctggctcctgggagcccggtgcggtgcctccaagcacagaacacctggaccctctgctgaaagatgctcccaagcaccttcccagttgccctgacaagggcttcacagataaactgttctacatctacacatccggcaccacagggctgcccaaggccgccatcgtggtgcacagcaggtattaccgcatggctgccctggtgtactatggattccgcatgcggcccaacgacatcgtctatgactgcctccccctctaccactcagcaggaaacatcgtgggaatcggccagtgcctgctgcatggcatgacggtggtgattcggaagaagttctcagcctcccggttctgggacgattgtatcaagtacaactgcacgattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgggggcctgtggtttcaatagccgcatcctgtccttcgtgtaccccatccggttggtacgtgtcaacgaggacaccatggagctgatccgggggcccgacggcgtctgcattccctgccagccaggtgagccgggccagctggtgggccgcatcatccagaaagaccccctgcgccgcttcgatggctacctcaaccagggcgccaacaacaagaagattgccaaggatgtcttcaagaagggggaccaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctcctagcctgtgtgcaaaccacccaagcccaccctgaccccagaaccccacagccccactgtggccgcttgatcccccacgccaaccccctggcccattgacccgcctcatctgttcattcacttatctaagctgagggtgtagcaggtaagatgccgcagcccctgcctccaatgtgctggttcagccgggggcagtgcccatgtgaatctggcaaggtgtttaacagtgtgggcttgaaagtccaaaccaaaatgtca

SEQ ID NO: 7748 - DNA, 2858 bp, Homo sapiens
cggcttcggggaaggtgcggcaggcggtgctgcggcctggcacagcaggtttggggtgcgggaggcgggcggggtaggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatctttggcggcctggtcctcctgaaggtgaaggcaaaggtgcgacagtgcctgcaggagcggcggacagtgcccattttgtttgcctctaccgttcggcgccaccccgacaagacggccctgatcttcgagggcacagatacccactggaccttccgccagctggatgagtactcaagcagtgtagccaacttcctgcaggcccggggcctggcctcgggcgatgtggctgccatcttcatggagaaccgcaatgagttcgtgggcctatggctgggcatggccaagctcggtgtggaggcagccctcatcaacaccaacctgcggcgggatgctctgctccactgcctcaccacctcgcgcgcacgggcccttgtctttggcagcgaaatggcctcagccatctgtgaggtccatgccagcctggacccctcgctcagcctcttctgctctggctcctgggagcccggtgcggtgcctccaagcacagaacacctggaccctctgctgaaagatgctcccaagcaccttcccagttgccctgacaagggcttcacagataaactgttctacatctacacatccggcaccacagggctgcccaaggccgccatcgtggtgcacagcaggtattaccgcatggctgccctggtgtactatggattccgcatgcggcccaacgacatcgtctatgactgcctccccctctaccactcagcaggaaacatcgtgggaatcggccagtgcctgctgcatggcatgacggtggtgattcggaagaagttctcagcctcccggttctgggacgattgtatcaagtacaactgcacgattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgggggcctgtggtttcaatagccgcatcctgtccttcgtgtaccccatccggttggtacgtgtcaacgaggacaccatggagctgatccgggggcccgacggcgtctgcattccctgccagccaggtgagccgggccagctggtgggccgcatcatccagaaagaccccctgcgccgcttcgatggctacctcaaccagggcgccaacaacaagaagattgccaaggatgtcttcaagaagggggaccaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctccta

SEQ ID NO: 7749 - DNA, 1262 bp, Homo sapiens
atgaaataagctcacactgttacctggtaggtactcaaagggagacatcacagtcagaagacctccgttctggtccccactctgctgtcactcagcatgtgacactaggcaaatagcctcccttctccaggcctgttttcccatctgcaaagtaggggtgggtgggtaactagcagctgtccccatgccccaactttgccacagctgctgtatgaccattctttgcaaactgtaaagggctgtgcctcctcccccacttccctcccctgtttgtcctccagccctgctccctgccttcctcagtactggtggttgggaagctgggagctcgggcccctgccctgcactgagtcttcttccctgctctcccaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctccta

SEQ ID NO: 7750 - DNA, 434 bp, Homo sapiens
gcctgttcccaacagccaaacatgcaggtggaaagaatttactgagtgttgactgctcccagcctcaggctaacaccttctctgcattctttcctttgaagtacagcacagaagagcaatccctggagccagagagcctaggttcaagtccaggctccaccgcgtacttgctgtgggactctggtcaggttacttaacctgccctgcctcagcattcttcaccagtgaaatggggaaaatagtaagaactacttctagaattatagtgagaacattagttgctacatggaaaacccctagaacagtgcccagcacttaataagcacacaataactgttggctattgccattactattcatccacagagtagttatggaagatagagtggatgcttctttatcaagatcaaagggggcttttttttttttgagac

SEQ ID NO: 7751 - DNA, 601 bp, Homo sapiens
aaggcatgccaatagttttctcttgggcattggtttttaaagtataattaaaaaattatggatcagaactgatgaaagatttacaaattctagcaattgaaaaagtatctaagattgggaataaattgtgcaagtgtgttaattgaactgataaattgagctaattgtcttgcccaagatacttaactgaagggtactggagtgaaccaaagggtttagaaaacattggtagaatatgtaatcaagaggatttgcaacaatgtttgaaaaaatattttatattgataagcataaaagattaaaagcaggctgggcgcggtggctcacgcctgtaattctagtactttgggaggccgaggcaggtggatcacctgaggtcaggagttcaagaccagcttggccaacatggcgaaaccccgtctctactaaaaatacaaaaattagccgggcatggtagcaggtacctataatcccagctactcgggaggctgaggcaggaaagttgcttgaaccccgggggcagaggtggcagtgagccgagattgtgccactgcactccagcctgggcgaaagagcgaaactccatctcaaaaaaaaaaaa

SEQ ID NO: 7752 - DNA, 288 bp, Homo sapiens
tcccaaattgtgtcaattaatttgaatactacaaaatcgtgcctgctcaagtaggacagatgttgcatattacaatacacactggctgaaagaatgtcaggcagcctattgtgcgtccttctgcatttatttgtactaaatgaacaggaaacatattagtttatttatttatttatttatttagagacggagtttcactcttgttgcccaggctggagtgcaatggcacgatcctggctcactgcaacctccacctcctgggttcaagtgattctcctgcctcagcct

SEQ ID NO: 7753 - DNA, 592 bp, Homo sapiens
catggcactttccacagctagtgtctctgcatgcattgtcgtttggaagcagaatttaattcacttctgaattactttgcttgatgtaagtatgacttcattcacaggaatcttggctaggtgaggtagtaggaaaaggtaagggtgtaaactgtaaccttcatacattagccattttccccaaaatgtatagatgtactggtattttttgtgtagcagagaacaaccttaggaagtagtattttttaaaaggccttttaacctccaaggtaaaataaaggtgtactataaagccatatggtaatactttacaacagctggactgagacaatgtactgctaatttgcgcagttcttttatgtaggctaaatgtctttcttttgctaaatgcagttctgaaggcaagggtattattaactgctggtgctgccccctggtattccgatattcactgctaattatataagccagtacactagtcttagtgaaccatttttcttctgcttggagatatttgatcagaaggaattccacctctggaacaacttgtactaggttagccccctgggaaaattttaatttacaagatcct

SEQ ID NO: 7754 - DNA, 348 bp, Homo sapiens
ctctatctcaaaaaaaaaaaaataataattatggaaaacaaaatttataaaaatctaaaagatatgtgatataaatgtaactcacttaagaagcatcttagattttgtattccccgtatgtttcagagcaattctattggttttaccttcgtatttttatgttggtgatgagaaaacacttaaccatttgtaggtttcagtaattgaaataatactttctggtagtatttttcaaatagaccccaggacccatttacattcttaaaaattattgaggatcccaggccgggcgcggtggctcacgccggtaatcccagcactttgcgaggccaaggcaggtggatcaca

SEQ ID NO: 7755 - DNA, 616 bp, Homo sapiens
ctctgaaattggaatacatcttacagttgatagtatcttatataataattgccactgtttttctttcttaaatcctgtaaaataatgtatgtttacagttggcagcatcttagatttgatgaaatatggtataataaacaagcacatagaaacaaaactagcatgaaatacatcaaaatgttataaacggtcatctctgggtgctaacagagctataggtgatttttattttcttctgtatgacttttccattttctaaatattttacaataagcctatattacttttataaacaaaaaactaaaaatttattataaaagtgaaaactaaagccgaatatggttgagatgatacgagagcacttaagcagttttaaatgtattcaagttggtgggcccaagtagggcattgaatgtacttgcaaatgagattatggaactacttattggcattaaagtgaaaagctctaaagcatagaggacagaaatactagagagattcaaaaacccaattttcaaattagtatggattctattcactgctaactaatcagcttcatgatgaatcctaaccaagttataaagcaaagtattaaatagtttgtgagcccatgggg

SEQ ID NO: 7756 - DNA, 469 bp, Homo sapiens
aaattaccataatttcccacttttctggaaagaggctcttaaaatatgggtaattttctaatgtcaaccatatcttacattttggtagagggctctctctctctttttttttttttaatctttgcaaataatcctctttctgtcttaacataagtatatgtgtacatcaaaagctttactctcaacaatcattttggaagcaaagaaaatatacattgggaggctgaggtgtgtaaatcacttgagctcaggagtttgagaccagcctcagtaacatggtgaaacgcccgtctttaccacaaacacaaaaaaattagccgggcttcgtggtatgcacctgtggtcccagctactcgggaggctgaggtgggaggatcgagggtcgtttaagtccggaaagcagaggttgcagtgagccgagattgtgccactgcactccagcataggcaccacagtgagaccctgtctc

SEQ ID NO: 7757 - DNA, 1874 bp, Homo sapiens
  misc_feature (787)..(787): n is a, c, g, or t
ctaattcttaggtggggtcaagatgattgcggggggcagtgggggcagcctgtggtcaacgttcaaagccttccagtcatttagaaagttgaaatgtgcttggtgctgggctagaatcattaggaggaaatagctgcaaacctggaaacgtccctggagaatacttaattcaggaataaaggtttggattgatgagggctaaaataaaacttggcagcgacagcattctagtaacttttagccacttctccccatctcactggggtattcctgctggtatattcactagcctgagctctgctcctgagagggctgcaggagctgggtgggttgggagacacaggtgtgtgggaggcgccttcaccaagtgccgcacaattgccgggtacccctctgtgcctttaactggtcggtaaacagaaagcaggatgtgcttatctgaatagtgacaacagttgcaagcactcagtcacaaagttcagcattctggctttagatggaccagcgtggggctctggaagctggtgacttgggagtgcctgccgtacacatgggtggggaagggatggaaagtttagcaaggacttgccgagttattaagcaaagactctgtaagtgcgtcagaatgggaaggcagctcagaacctttccacttcaccctttttgttgttggaaataggtaaactgaggccagtgaacaggaatgtgtatttcaataataccaaagctaacttctatcactgtgagttgtgtgccaggccctgggttcactgccttctgagtgttntctcttttaatctctgccacagctctgtggggtaagcactggtgttatacccatttttcagataaggaaacagagcctcagagagtcaggttacttcctcaaggtcatagaactagtaagtcacagacctagggcacaggagcaggtctgtgtgggggtcagagccacagctgtcccccacacgctgggggcctcctccacaaagtggtttcaggtggggctcagcccacctctgggggaacccattcatatactatgcaaggtttcacaggtgtgtgaattcattttccattgctgcgtaataaattaccacaaacttaatagcttcaaacaacacatatctgtcattccacagtttctgtggaggccaggcctggttttcctgagttctctgctcagagtctcacaaatctgtactcagggggtcagcctgattatggtctcacctgaggcttgggatccccttccaaactcactaactgttggtggaattcaattcatgcagggagagcactgaggctgcaagctcatggagaccacccactgtttcctatgtgtggccctctccacaacacagccctttgcttcttcaaaacccaaccaaagaatctctgtcttcaggaacagcctccgaccctctttgaaggggctcacctaattaggccaggcccacagaggaaaagctctcttttgattaactcagagtcaactgattagggactttatacctgcaaaatctcttttgccacacagcataacttaatcaaaggaatgtattccatcccattcatggatcctgcccatactcaagggaaggccataatacaagcatatggtcattaggggccatcttagtcactactgttcgtggattgttctccagcttcctggaggagaggagagcaggagacagagctaagagtgtttgtaaaatagggcagtgggaaaaggtaggtcttgtgagtagcaggctacttaagatgcctagtgggtctaaatgtcaaatgctattggcagattttccgtgcaaggtatgaccaaaaaataattatttcattaactttgtgcaaaaaaaaaaaaaaaaatg

SEQ ID NO: 7758 - DNA, 375 bp, Homo sapiens
atacatatcaacaagctggataataccacttgaggattaagaatgaggttttttttgcaccaagttttatatatcatctttgaagctggccatatcagaggagaccttctaaatatgctttaaagccatggcagcatcattggagaaacctgtatgtcttcccaagatgattatgttaaaggatagcttttatttggatatttaagttttgatgcatttatttaaaaaacaaaaaacaaaaaaccaatccggtatttggtattcttgccacagatctgtaatcaagacctgataataaggtttatggatttctccaaagcatacattttctttcattgctgacttacattttatttctacctctcatttagcatg

SEQ ID NO: 7759 - DNA, 486 bp, Homo sapiens
tgacatgtgcatgtgtaaaataagtgctgttatctaaaaaatacatcataaaagtttaccgtacagtgtgtgcacccttggacatgaatagaagacaaaagcaataaagccacttagtagtggtttactaagtgttctgccactcttgacagggtcctggtctaaagctggcactgtcagcatgtgaaaggctgcagtctgtaaggacctggggaagagaagacattttctgtatgaacataattgtacagtaatattgagcctgagttgcaggttttataaaggaagaggaggctaagtacttactgaaggaagagctagaccttttctctttattctattatgggagatttttgacattttatgagttagaaaaagttatctttttcattctgatctgttagttttatacctttaatccccaatcttactgtgaattactggagtctatttttaaaatcttggaaattttttatttagtgctgc

SEQ ID NO: 7760 - DNA, 905 bp, Homo sapiens
aaagaagagcacctgtgggtaactccgtactagttgtggggaggattttcccacctttgcttcttgacacttaatctactgagtcctttattgctgagtttatggtgagaacagtgattctcaacaggtgattctcaaaagggaagactgggcagtttcaataatgataatcagtattctaatatttcacattaaggaaaagaaagtctattcattccaccacacacactatagcaggaaaaactaggccaaactcttcttgaccaatatagatatggtagatatggaaaagaactggtgtgggggcaggaatgaagatgggaacacccccacaagaagccagtaacagaatgtccttaggaagaatgagattcttgtccatcaaaaagaagtaggaactaaacaaggtcaagaacatgaggttggaggttacattgtgtggctggaaagaagccacacagagactgagaaactgagaaggcaaggactcttctgacagggcaaggtggaaggtggtggaggaggtgacggtgctattactggctttcacagataaatgatagaataagggatacaattgacaacattgagttgtcaatgagttgcccctcagaggggaaaagaggaatttctctcctagaaacctcagttttgctattgttgtcattattgttgtgttaacttcactccaagaagatcagtgcccatgaacataccttacactggaaaaactgacttgctaaaaagaaactctataaagcagactaactctgagggacttttcctcttgacttttttccttgttgatacgtgaccccatgtcccagcacattgttagggtcctgccattaaaagattgcagaatgtttaataaaaacattttagatctctttaaccatctgctt

SEQ ID NO: 7761 - DNA, 750 bp, Homo sapiens
ggtttgaaatgaggctggtataacagaatagaactttggtttgacagggagtatacagactttaatattaggctggtgcaaaagtaattgcggtttttgccattactttcaatggcaaagtatgtggttgagtatgatatggccttgaagtatttctacatttggattagttaaggttacaagtagtttgcatgggtttagtgcttataagcattgttagacaactgtcgtgatggttacatgttatatagtttcctaatgtctccagactgctccagatatctgggataatctgagaaaaataataatctttcttattattaatgaccaattcatttagcactttatagtagtggtttttattttttggtttttgtcactcgccaacacaaacatctcttttggaattcagtggccactttctgggtgctctagaggaccattgtgaattaacatggcctaaaatcgtattttaagaatatcatgtaatacgtactgaatccagtttaagaagtttgactaaagcaaacaatctaaacaatttaaaatgactttgaatccatccaaaatcacatgtgtatttacctatcagtattctgcaggtcaatgaaattacatatgagtgaggttactccattacaacataggttgtaaaagcaaaagattagaagcaaggctggtatccatctaaagggcactgggtgaataaacaacactgcatctacacaaagaaataatgtacttctcctt

SEQ ID NO: 7762 - DNA, 447 bp, Homo sapiens
ggtgtgagccactgtgccaggcctagatttgggggccaccattcagtcgctgctctcccacacctgcagcagccccagcccgcccgcagggaaccttccttgtggcagagacaacaggaaaaggaaaggaagaggaacccaggcctgggttcccggcagagctgtccgcagagcctgtgcggggctgcaaaggcccctctgttgtcacaacacccctggtccccgtttcagatgaaaccgggagaactttcaactgcaacaaacactcctgggaaaaggagaggccaatccccatggcttccacagagagcacagccagacccctttcatccagggcccacaggcaatgtttgttcgattttgtttctttccttttgaaaaaaaagggtgctggtttggtttccagttttactgcagacacacagagaggcccctctctggctcaga

SEQ ID NO: 7763 - DNA, 242 bp, Homo sapiens
gacagacatcacttgtcagcaaatctaacaaaaaccaaaggtatccttaaaaaatattagagaaacacagtattattgtagtttacataatttccctcaaacatagtaatgtctctttttcaattaaatagcagtaactggggtgctgccaaaatgctctagtatgcagtgttcctatcagcatcagaacagtaattcacctctatcctgtcactaattggcacaagcattcacttctgccc

SEQ ID NO: 7764 - DNA, 516 bp, Homo sapiens
gaaagatctcaaattaataatctaacatcacacctagaggaactagagatacaagaacaaacaaaccccaaagctagcagaagaaatcactaaagccagagcagaatggaatgaaattgagaccaaaaatccataaaaaagatcaacaaaagcttgaaagcttgaaaccttgaaaggaaacgttggttccttgaaaggataaacatgactgatgaacttcaaaagtaaccttggttccttcaaaggataaacatgattgatgaaccactagctagattaacaaagagaaaaaaaagatccaaataagcacaattagaaatgacaaaggtgacattacaactgatcccacagaaatacaaaagatactcagagaccattatgaacaaatctatgcacatcaattagaacatctagaggaaatagataaattcctggaaacacacaacctcccaagattgaattggaaataaaatgaaaccctgaacagaccgataatgagttctgaaattgaattag

SEQ ID NO: 7765 - DNA, 347 bp, Homo sapiens
agacatgagctgtttggagtctctgactttggagaaggcctaagccgtcttttaaaaggctcacctgattaggccaggcccacctggagtgaactctcttttgatctgacttaaagtcaactgattagggacttgaatcccatcggtaaaatctcttcagagcagtacctagatgaattactgggaactgttgtttggcctagccaagttaatgcatcaaaaagccatcacaatgctcaaatgccaaaaaccactccaggctctttccttgtagacattgcctcctctcatatgtcctgcagacaaagccagggttgttttttaagtcatgcttgcacgcattatca

SEQ ID NO: 7766 - DNA, 877 bp, Homo sapiens
gccaagagggaactttttaataaagctagtgggattcccttgacagcagaaccagccttgggacttgatgcttcaccgtgtcagaatccgtccctggtgctgcctttcagagaagaggcttgatgtgtgaggggtcagggggagtgctccagatccctgaaatgcccttcccagaccagtgacaggcatttttgggtgccatcgtgtgaccttcacggcacagcaaacagtgggcactaaccctgttgtcctgtggaaatctgggtctctgaatcctgccatttccttcctggaattggccaggaacttgattttctgggctattgcttgctagtgtcccctgatgcatgaaggatccccccatgtcataggtcccacctgcctgctgtgcatcccgggtggccagactcggcttctccaggtgcacttgtcccaggtggcccggtccgtaggctggaagggcagctgcaggtgcactgcctcgcggacaggttaggatatggccacgcagccatccatcttctacagcacgcacaccccactctctcccccagtcaatatgtctctctccgatgggaaagttaataaattttgctctagattaaaagtattgatcatttcatttgtaaacgataaataaaaagggggaacttttcattgcgccaggggtggcacctggcgtgtgttgcgggggtgattgcgctggctgccggggggtgggcttctcatatgcattctggccggccagctgcattgatttcctattagtctcccagcaccacccagtaacacatcatttcagtacctgctattaatggtcttttgataaataatcacttgtaagtcaataaatttttattaaacagtgaaaaaaatt

SEQ ID NO: 7767 - DNA, 350 bp, Homo sapiens
tgagccgagattataccactgccagcctgggagacagagtgagactgtgtctcaaaaacataaataaaaaataaaaaataagcacataaatatataaatacagatggtaataacacagcaaataagacatttgggaatatgcaatatgtggttgtgaataacaagaatgctagattaattggaccataagtttgtggtgagaaatagtgggaaaagactgcaagagagacaggagacattgtgaaaagcttttaaaagcattgtaaaatgctaacttgaggaatctgcattttcttaggttggtggagggaagctaataaaggtattttgagcaggacagttatatgata

SEQ ID NO: 7768 - DNA, 156 bp, Homo sapiens
ggaggcatatgggctatgacttgagatgctaaaagagccataaaagaaaagcaaggtatcccttttcctccctgctcaccccaccccaaccaataaattagtaagaggatcagataatcagcccttacaatgccggcatgtccctgatttggccag

SEQ ID NO: 7769 - DNA, 312 bp, Homo sapiens
cctccactgagcagctagagggacctctttaaaacatccactggtcaggccgggcacggtggctcatgcctataaccccagcactttgggaggccgaggcgggtgcatcacctgatgtcaggagttcgagaccaccctggtcacatggtgaaaccccatctctactaaaaatccaaaagctagctgggcatagtggtgcatgcctatagtcccagctacttgggaggctgaggcaggagaatcgcttgaacctgggaggtggaggttgcagtgagccgagattgtgccactgcgctccagcctggtgacaga

SEQ ID NO: 7770 - DNA, 788 bp, Homo sapiens
tgagtaattttagcagcctccaaagatgaccaaggaggaattttaagtcattaaatactcatgaatttttagatatctgatgtattttaattctttctcacacacaaattatcccatttttggccagtgggagccccttaatggcagttcttgtgtctttctgatatgaccctaaaactgcctttacaaagttatgacagtaagagaaagctggcatagctgactccatcttgcttctaacctccaagctgtcattgctgggcataggtcaagctaactttgggaggattttagtttacagtttaaccttaaagcaaggatgataatagccactcccaaaattaaaccacctttgtaaaaattaccggaagaccacaaggttagggattatggagaagggcctggaattctggttaaggatacaggcatagttaaacaataaccagccattgttccagaggtcacaatatgtgtaacttctccaattattcctgtagataacatcactatcgtagaacctaagactggccttttgagatgtttttagacttttacatttatggcaaccaactgactctacccagaccatgactcgtgactgaaatggtcctgtggcccccatccagaggctgactcagcacataaggaccatttttccaggctcctatgactgcatccccaactaatcaacatttcccattccctagcctcctgcccaccaaactctccttgaaaaactctaacctccaagccttcaggagactgacttgaataattccgagttcttc

SEQ ID NO: 7771 - DNA, 370 bp, Homo sapiens
gatggagcggggctcctaaggacaaggagcacagtgtctgctttctttgcaagcacagtgctgacaaggaacagaatacccacagcgactgcttccaggaaacggctgcagggcgggcgggactctggcgagacgcgcccttcccagcaagccggcctgcagagttgggattttctgtctccattcggtggtataccaagtgcctgcctcccacacccagctgcccctaatccctgcctgaaaacgtgctcctgggtcacggaattcatgctgagacacgagccacacacagccagggctcaggggtccaccctccagggaacaccaccccgctacagggccacgatcacacacacaccccgcggagcat

SEQ ID NO: 7772 - DNA, 425 bp, Homo sapiens
aaaggttcacatcaaaactcagcgaacattgaaaagggataaatgaaattgttgactctgcagcttcctgaggcaatcaactttggatctttgcctgtgggagcatttcatctgagtgagagaaaaggtgagcaggcatgagacagatgactttcccaggtctaacagttctgccagagttgtgtgtgtgtgtgtgtggttttttgtttatgttttttaatctcagaaggaagttatctttgtggtatctttcattcaaagttcttccaacacatattaagaaaataacaaactagtggattttattttaccagtacatttgtgaagactaatgctgagcctagactaggatactagttgtcatctgaatatgaatgtgtagagaaaatagagatgctatgtcttaatggatagtgaattgaagg

SEQ ID NO: 7773 - DNA, 266 bp, Homo sapiens
gtgaggagagtgtatgtgaccagttgcagcataattaagagggactgtccattgggtgccaaacatccattggggtttctacttaacttttttaaaaagttgtttctataagaagagatgtatacatggaatagtcactgcagcactgtttgtaataacaaaaaactagagacaaactaaatgtctatcactagaaagctgtaatagtaaattatagtacatctatattgtgaaatactatgcagccatcaaaaagaatgaggccc

SEQ ID NO: 7774 - DNA, 714 bp, Homo sapiens
tgagacagggtctcactctgttgcccaggctgtagtgcagtgatgtgatcacatctcactgcaggctcaaccctctgagactgaatcaatactcgcagctcagcctcctgagtagctgggactacaggtgtgcaccaccacacccgtctaatttttgtattttttgtagagatggtgttttgccatgttgcccaggctggtcttgaactcctgggctcaagcaatccatccacaaacgttggcctcccaaggtgctgaaatgacaggtgtgagccaccacacccagccaactgtcttaaggaaaaagaggcacagagaaactaaagtttgtaaagtcatacaacctgtgctcttgccaacagaaataagaatacaaatgagaagtctgagcatatcaactgtcaaaacctgtcacatatgtctctactccaagcaagacaccaggcagagtctttgtcatgactgtactggccaccagagttcacctcacctgccagcccagctgaactgggatggctgcctctaaggctgtgttgaggccatagctgggctcaaggagaaacagtaccggagtcacactgaaactttaggcagcatatacctccatcaatatgatcaatgaggcagtacacgagagcacataggaaactgccaaggactttaccaatgtccgatgatgatgactgtcatctcctcagaacaccagattcaaaa

SEQ ID NO: 7775 - DNA, 441 bp, Homo sapiens
gccacgccacgtaccaaaaggctcgcgaagaaaaacgcgggcgaagttcagcatccccgaacagaaagggaactcattccagaaggggggttcacgggtctgagggtccttgggtggggaaagcagtattggagggagaagacagaagggatggcaagacagaggaaaccacggggacaaaaaggaagggatgaggagccctcttactataaaagggactgacggacgggatgcagagcaatgggcccccctcgaaaaatggactggcaggcccttccgcacccccaaacaacctcgcaccacctgaaagcggggagcttgagtttggggctgcgtagatcaaagcagggtaagacgaagggaaagagggaggggagcttggaagcaaagtgaacaaagaggcaaaagaggcaaagttggaaatggaaacgagaaagggag

SEQ ID NO: 7776 - DNA, 512 bp, Homo sapiens
gtcgacttttttttttttaagacgggagtgtcacttttgttgcccaggctggagtgcagcaagacactgtctaagaaaaaacagttttaaaaggtaaaacaacataaaaagaaatatcctatagtggaaataagagagtcaaatgaggctgagaactttacaaagggatcttacagacatgtcgccaatatcactgcatgagcctaagtataagaacaacctttggggagaaaccatcatttgacagtgaggtacaattccaagtcaggtagtgaaatgggtggaattaaactcaaattaatcctgccagctgaaacgcaagagacactgtcagagagttaaaaagtgagttctatccatgaggtgattccacagtcttctcaagtcaacacatctgtgaactcacagaccaagttcttaaaccactgttcaaactctgctacacatcagaatcacctggagagctttacaaactcccattgccgagggtcgaccggccgcgaatataaaat

SEQ ID NO: 7777 - DNA, 377 bp, Homo sapiens
tttagtcaatccacacagtacctactttgtacaaaatgcctggatgtgcaaaaaattacaggccttacttatccttaagggtaagcttactatatagttgggaaaatagaaatgtaaaaggtagaatagcagtatcagagatgacacttcaaagcagtaagtgattaattggaaaattgaatgggattagctgggtgcagtagcttgttcctgtagtcccagctactagggaaggctgaggtggaaggatcactggaacccaggagtttgagagtttgaggctgtagtgcatcatgatcgtgtctgtgaatagccactacactccagactgggcaacacagtgagacctgtctcaaaaaaaaaaaaaaaacagagtc

SEQ ID NO: 7778 - DNA, 312 bp, Homo sapiens
tagcaaattgaagccacaagtgtataaaaatggtaataacatcctagccagcttgagtctgttacaggagggcaaagtcggttcattagaaaatctgttcatataatttaccacattaacagatgagggaagtcaagttatttgattatctaaattgatgcaggaaaataaataacactgaatatctgttttatgataaaacacttagcaagttaggaacagaaggggacttctttaacttgatgaatggtatctacagactacaatagatttaacagtcagccctctgtatctgtgggttcaaccaactgg

SEQ ID NO: 7779 - DNA, 435 bp, Homo sapiens
gctaggagtgcctccttgctgttcctcttgttgtttccactgacagtggagtggccttgttactgctgggtggtggttgagagttctggctctctactagggaggacacaacctcagtgtagagaggcggggataccttgttactgtcaggcacaggcggaggtccagtctccttactccacctacccaacagggtagcttgaggcacttcattattgcctagtgagagtggaagtttaggccttccactcccttcagtcttttctggccagggtgaagattgggccacagtattttctgtggtgtttggctgaactagaatagttattggctaaaagtttcctgttttatggtctgctcctttcctggtattttggctagagagagccaacttttgcagacacttgtatatttgttgttgttggtggtgctgct

SEQ ID NO: 7780 - DNA, 501 bp, Homo sapiens
agctgcttccagattggcttctagctgccagtgtgaccttgggcagaaccttcaatgtctgtggggctgtgttttcttatctggcaaatgggaattatgctgttgcctcgggaatgttggaaggtcaaagacagtaagaagtacaaaagctgcagagaatcagtgctgcctgcacaagcatgtacaggagagtcccctgtcttatctggagtcagggttctggggatccacctctcgtgcgtgttatcccatctccaagcctgggactcctgggacaatcagaaggtgagctacctgggtgcaccctgctttgggaaaaggctgagtccaaccacctggctcactttttgggtgggacccctagctttttagaagccagaacaaacttttggctttgctggaactcagaccaggagtcactctgggaaatgctgaagccacagtaatcccatgccctgtccccactgggaagcaggggacagaaaatagtcctgagggaga

SEQ ID NO: 7781 - DNA, 516 bp, Homo sapiens
tcaatagtttttccttagcttatgttcagtattttcttcccttaaaaatataggcttctaagtaaattagtgaatatgtttaaaagatactaatcactcttatgcttctttagacggtcacagaggtcctactgctaataaagtgatatttctacttaatgccatgtttgagacctccaattaaacatttagaggccaaaataacaataaaaaaactgatttaaggctgaatttttgagacctaaaaatcatgatgtaaaaccaacatgtcattctacatttttttaaataaaaagaaactaaattcacatatgtcaaagtcattttaaattactataaaaattaagaagaatctcttgtactgaattgcttctcggtgcttaaaacaagtagcaaaggctgggcacggtggctcacgcctgtaatcccagcactttgggaggccgaggcgggtggatcacaaggtcaggagatcaagaccatcctggctaacacggtgaaaccccgtctctacta

SEQ ID NO: 7782 - DNA, 675 bp, Homo sapiens
ggctcggtacccccctaatggaatcttccatttttgcaatttcaaaactctaacttgctgtaaaattcccgaattcttttatcatctggtctcacttcacagaaagctccccgggagccattagccttcagtgaagacaggaggcaagccatcatgcttttggccacacttgggtcagatacttttttgtgaatgtccatctgtatcataaaaggggaaatttttatttcatctttaacttcaatttaagtgaaagaccaggaagtaatgcactctactttgcgtaattgaaggcaataatttaatcatttaccagtgctgtttctctctatactatgaaagtaatctctggaatggtatggctactgcctgatagtgtgcaataggagagagtatgtcagatttaggaccagcactttttatatgctcatttgtaatgggaatactgaagctataaataacaaccaagaatccatccttgtagtgtgttatgtatttcaacatagcatggtgagtagccacagaaaagaaacacttaccctgaaacaaagaatttttgtgatgagaggaaactgatggtaaatggaagagaagagggtgctctctgttgcctttttattcatttgtctagaaatcttgcttggttatctctctaagcaggaaagatgggattcc

SEQ ID NO: 7783 - DNA, 507 bp, Homo sapiens
ctgtatagaaagtgcatgttgtagcaagttcttagctcagaatgcttggcacagtacaaagaatactagctcaagcatgaagagagttgacttctactgccaatctaagattaactcgctattttcttttttttgagacagggtgtcactttgttgcccaggctggagttcagtgatgccgtctctgctcactgcaacttccacctcctgggttcaagcgattttcctgcctgaccctcctgagtaactgagactacaggtgcatgccacctgcccagctattttttgtatgtttagtagagacaggactttgccatgttggccaggctggtctcaaacttctgacctcaagtgatctaccctcctcggcctccgaaagtgctggggttacaggtgtgagccactgtgcctggccaactcagtattttcatttcagcaaattatatcacctttttatgtcttggattcctcttctgaaaaaatgagtatcataataatacgctgttg

SEQ ID NO: 7784 - DNA, 440 bp, Homo sapiens
ctactttgcgtaattgaaggcaataatttaatcatttaccagtgctgtttctctctatactatgaaagtaatctctggaatggtatggctactgcctgatagtgtgcaataggagagagtatgtcagatttaggaccagcactttttatatgctcatttgtaatgggaatactgaagctataaataacaaccaagaatccatccttgtagtgtgttatgtatttcaacatagcatggtgagtagccacagaaaagaaacacttaccctgaaacaaagaatttttgtgatgagaggaaactgatggtaaatggaagagaagagggtgctctctgttgcctttttattcatttgtctagaaatcttgcttggttatctctctaagcaggaaagatgggattcctcttctttagaaaaagtttctacctgatgacttaattgg

SEQ ID NO: 7785 - DNA, 426 bp, Homo sapiens
atcctaaagtatattgattcctgtgaatatttaaactctagacttttagatacctacatcatgccctgcccaataaacatgcttcaatttacccccacagttttagagcaggaactgatttgtacataatttcactgtttacgtttttagcactcctatccctgatcttcatggtgatgcacagaatgtcttagactccaaaaaggaacagcactagaagatgtgagcatatttaatttgtaatgcaaacctgccatttaggagtagaaaatgtatgataaaactcaagtattacatgcagatcattttaattttctactttgctttaatgcaatattgtttattcactccatgtattgtattcagagaaactcctgtattgtttcctactttgtgaaatatatttttataaatactttgttgtca

SEQ ID NO: 7786 - DNA, 354 bp, Homo sapiens
gcaaatcaaagaatcgtgacaataccaagtcctgggaatgacacagagcaatgggaactctcatgcattgcaggggactgaggtggggagcacaaagtggcatgatcagtttggaaaaccattggaaatttcccatcatttaatatacttccacctactgtgagccagcaatcccagtcctagatttttacctacgagaaataagacgacacaaaaacccattcccaaatgtttacagcagctttgttcataatagccagaaacaggaaacaacctaagtggccttcagttgggaaatggaaacaccacactgaggaatgcgtatgcccaggaaggccctgatctcgcctgtgg

SEQ ID NO: 7787 - DNA, 313 bp, Homo sapiens
tagtcagctgatgtgaatatgaatattaatcaatataaactgatccagaaatgtcacagagtatagaattggtagacaaaaacattaaaagttattatacccgcattccatatgttcaagcagctggaaaaaatattgatcatattaagtagagacattaaaaatatctacctgaaatcacattataaagaggaaaactatcattactgagatgaaaaatacactggatgagattaacagccaattagacatcacagaagaaataatttgtaaacctgaaaacatagcaataaaaattgtgcaaaatgaagca

SEQ ID NO: 7788 - DNA, 339 bp, Homo sapiens
atttgtgtgtgtgccttacacactacagtaggatgttcttgaggacaaggacttttcttgaaaattttcccctagcacttcgcagtctctggcttctgttttttcccttttgtcaaaggtaaaaattcaggatttgtttattgctttcatctcgaaaccctcctaatcaagagtgcttggtgactaaataccgaatggaaaattaagaacaaaaaattccagaaaatgttttcagtacaaatattagataatttttaaattttcaattgttttttaataatccaatgtggggcatagggtgtagagtgaaggggaagaaatgaaagaaaaagattgttc

SEQ ID NO: 7789 - DNA, 464 bp, Homo sapiens
tatcccaggctcctccagttctctttcaatcacaagccagactacccaaccacttaactctctaggcccagatatgacttaattctcccactcctgcatgtttgttgccacttccccattttgtgttaacaattaacctgaagtattatgttaacaattaacatgaattgtgttttggtttttaaggtcggagtaactaggattactcaataggatttaaatgttcaattttagcacacatgtacaaggcgctactttgtacatgacaagatgaagtggtttaaaaaaaaaacaaaacataaccacctttcacaaagggttctcattcagcctcctgcttgtgaaagatacgactttgaatagtgaaagtcccaagaagggtaattcaagcaaaactggtttctagtttgccttgattcaaattctttatgctacttgacccatttctcttttcctcttgcttc

SEQ ID NO: 7790 - DNA, 273 bp, Homo sapiens
cctggggcctttccctttactccttggcccccaacagtgtgtgattactcactctgagaagccacagttatcacagagaaagaaaaaaacacttgcccccagttagatcaaattctgagctgattaactctcaaaccagaatcacttggctgcaaggaaaagaacattttcttcatcttattcttcaccagcagttaaaaggacctatagttttgaggctaagtaccgtaattttattacttaaagccagtttaagaagctcagctcttgtaa

SEQ ID NO: 7791 - DNA, 586 bp, Homo sapiens
tattgtaactattagagaatttaaagttatacataggacttgcattatagttctattgcatagtgctactctagatacaactaccaatatacagagggtcatgttaaaagccatgaaagcaatctgcaaaatcagtgacgaactcacagggcaaacttgattttttcaacaaattgtgcacagaaagaaataagaaaaaaacgaaaaaaaaaaaaaggcaaagaagaaaatgtaaactgagacttgagaggtctacttcaatggcagtctgagatccatggacctgctcctcagaacaactgtaatcagtaaaagttactttaaaaaacctagccatttaaagtctccagaaattggctgggtgcagtggcttgaggcctgtaatcccagcactttgggaggcccaggtgggcggatcacttgaggtcaagagtttgacactagccttgccaacatggtgaaaccccatctctactaaaaatacataattagccaggtgtggtggctggtgcctgtagtcccagatactcaggacgctgaggcagaagaatcgcttgaacctgggaggcggaggtggcagtgggcc

SEQ ID NO: 7792 - DNA, 446 bp, Homo sapiens
gggaatgaagagacaagagctctctttatgccacgtgaggatacagcaaggccccaatctgcaagccaggaagagtcgtcacgagaaccagaccatgtaggaactctgatcgtggacatttcaacctccagaactgtgatccaaaatgcatatgtatctttggaagaaactctgaagtaaaggccggaatattctttgtttaaaacattaaaaacaaaacagaccaaagcatcaagcaagaagtttcctggcaataaactaagcacagcattattttttaaggaacacaaattaagtgttcaacctgtggcaaatttgtactttctccctgaattatgttgttatcaaagaaaaaaattgggaagcatggcaaaatatcatcaaaactgaaactagaattaaacaaaactaaattaaaatgaaataaaatgatgtccattcttaat

SEQ ID NO: 7793 - DNA, 471 bp, Homo sapiens
attcacatataagagatcctctataaggcaaccagtggatttatcagcagaaactttgcaggccagaaaacagtgggattatctaattgaagtgatgaaagggaacaagaatgtggttattttgccaagaaagaatactttaactcacaaagatgtccttctgaaatgaaggagaaaaaaagtctttcccagacaaataaagctgaggaaggtcatcatcactggatatgcctttcaagaaatgctaatgggactttttcaaggtgaaaaaaaatggatgataattagtaacatgaaagtacaatactcactagtaagtacaacaaaagacatacagtgactgaatggatgtataaaaataaaaaaaaaaaagacccaaatatatactgcttacaaaagtctcactttacccataaggaacacatagactggaaatgaagggatggattttctgctggagcctatgtgggg

SEQ ID NO: 7794 - DNA, 501 bp, Homo sapiens
ttttttagctcaaaatgtttatctaacagataaatcaaatggagctttctgtacatacctcattacaattctaatttattttcccaacagaatcttcacaattatgtaaaaattggcacggtcctgctagtgacacttcctattctttcataccataaagcctgagcttataaacaagctgcagagagaggcattttcattacatacatcactgcattgtggcggtatctccagaagggcttaaatgcatcatgtacttttacccaaatggtatctgaacaagagtgttggaagagatgtcagttcttgggccctgacaatgttgtttcctagcctaaaaagtctgagaaatgtggaatattcctacctctttctgtgagaagtcagaaaatgaagagacgtattcatctttaagccaaccttccaaatttacctgagcatagagcaccaccccttcaccaccaccctcttttctttcctttggaaattcttattaacatt

SEQ ID NO: 7795 - DNA, 431 bp, Homo sapiens
tgagttaacggtatttcaagccaaaccccagtatatgatgcagaacaaggacccaaagtgaggctgaaaggtgaacttgcaagtacaggcttatcatttcatggaatatgattatttagctattttaaagcagttgcttatctactacaggttacttattgtatggcaaaaatgaaaacacagatctctgtggatccaaaaacattttggaagctatgttaagacatcatttacgttggttttcacgtaagtgctgggctttgaagcattttttatttttttaagacacaggatctcactgcgtacactggcgtaccctggtgtgattatagctcactgcaacctccaactcctgggactaagcaagtctccccgctcagcctgtagctgagctaccacgtctggcctgaagcatttctagttctagtttg

SEQ ID NO: 7796 - DNA, 458 bp, Homo sapiens
taatgagggtgaatggaagctaagagtgcatcccacagcccaggcagttccagacctgagcctgacggcttctgccagggccacataccaggttcttttccttgatctctgcccacgtgtcagcctgggccacttgggctgcggtctgggtaccatccactccctcattaagcaggagccccacccacaaggctcactgcccagattgccccacaccctggcacctggggaaggcagtgttgccgagggcctgattggtgccaggcactgttctaggccctcagggatctggcacttatcaaagtttgcaaaacgccgggtgcagtggttcacacctgtaatcccagcattttgggaggccaaggtgggaggattgctttagtccaggagttcaagaccagcctgggtaacatagagagacccagtctctatttcaaatatatttatattaaaaaaaa

SEQ ID NO: 7797 - DNA, 305 bp, Homo sapiens
gcccttaaaagagccaaagaatcactggtataagctgagtaatttgggggaggcaaagaagattctcagtgccttccttttctacctaaaaaagaaataatatcgatcaatttgggaagttgataaggctagtcaacacagacgaaataaatgagaacttctcattcatcataatgttatggagattatcagcataatgttactaagattatttttaaaagatagttcttgaaagttatgagaaagaggacatgatgagggagtattgcttactgggataaaccatacactagggactcaagcat

SEQ ID NO: 7798 - DNA, 312 bp, Homo sapiens
gtacgacaaaatgactgataagcatctctttctcattcaaaggcaagtagaggtaaatccctctttccagagtgaataaactttttcaacaacctctcacagtagagacttccacttgagtttcattgcccagatgcttatcagtcattttcactaataagtttacaacagtgacaactgtatggcaggtggtatgtaggtctatgaaagcgcaaagggcgtctgacttgggctgggtgcattcttcacctccctttaacaattaagtgttatcaagtactgaagcagttaatctgattagggcataggcag

SEQ ID NO: 7799 - DNA, 926 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgtaagtattttttaaacaattctattttaatcaaattaaaatttagctctatttattttgaattatagtatcaccagttatagtaacttggtaatgtttttgctttgtgaatcatgttaaaaatgggaaaatttagctacctgaaagctacttattacttgaaagaaagatttgtggtaaattttcttggacttgtgttatgtatttagttgctatacggatagcttcttattagatcaaaaattcctaacaaagaaattagtcccaaatgcctgatttctttttgaatcatgtcaaagatggctttggattcactttctggaattaatgtgcatctgttcattggcatatgttgggtaatgatggggtgactttctatggattaataatgttattttactacatataggtatcatttattttat

SEQ ID NO: 7800 - DNA, 2234 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgcatctataaaccattcaccaaagacatgcttaatttttaagagatcaaggtgtaaattatgatgatttattattttggtctacagtgtatgtaaggttagtatgttaagcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattg

SEQ ID NO: 7801 - DNA, 1066 bp, Homo sapiens
  misc_feature (3)..(3): n is a, c, g, or t
  misc_feature (5)..(5): n is a, c, g, or t
  misc_feature (1024)..(1024): n is a, c, g, or t
  misc_feature (1065)..(1065): n is a, c, g, or t
ggngnagcaaagtgccgtgggaccgaggtattatggtgcagtgacttgacgctcgagcctggttgggcctgggggctgtaggcggagttcacagtatctagcgatggagctgataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatatattacctcagctacttgggaggctgaggcaggggaattgcttgaaccagggaggtggaggttacagtgagctgagatcacnccactgcactccagcctgagtgacagaggaagactccatcnc

SEQ ID NO: 7802 - DNA, 1241 bp, Homo sapiens
  misc_feature (339)..(339): n is a, c, g, or t
  misc_feature (1016)..(1016): n is a, c, g, or t
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcactctgagagtccatgatgggcagatcacttaagcccagaagttcaagaccagcctgggcaacatggcganacctcgtctctacaaaaaaatacaaaaattagctgggtgtggtggagtgtgcctgtagtctcagctacttgggagactgagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtatggttgtgtgacatgttcaaaattaagactccttgcacagtggatccatgtatcctaatatgcttgtaactaggatgaancaacttttaagtggttaatttatgttctacctctgtatttgaaaatccatggtattttaattttttaccatatcgttcaagtttggtaaaggagaatttctctaaagcagtgtttccttacatatgttctgtatagtgctagccctgataaattctctgtgaataaatgtttccagtgtcaaaacgtttctgttaaatgttctttgaataaatgtttccaagggc

SEQ ID NO: 7803 - DNA, 950 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaagtgagacaatgggaaagccacccgcttcagaacattgaagaagccacctggcaccaactcactgtccaagctgagaagaaggaaccagggacccaaggagcttcagtttaatataaaaccaggagcaaacctccgaagtccaggcatctcagagaaatgctttttttgtgtaccatggttaccaaatacagagctagattttatttttgtaaatattt

SEQ ID NO: 7804 - DNA, 2076 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgcatctataaaccattcaccaaagacatgcttaatttttaagagatcaaggtgtaaattatgatgatttattattttggtctacagtgtatgtaaggttagtatgttaagcactgtgctaaaaatactagttcagtcataattatgcccgaatttgcacaaagtttaatgccacggaagctatcattccgtacgggtctcttaacctaacttcctttaaaccgactttacctcccaagttataacggatggttcccccaagggacaaaggtatttcttgcaaaaatgggccaggttcctgccaggggggaccccccaatggcggggaaaa

SEQ ID NO: 7805 - DNA, 1368 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaatagacgttccatgatgatggattgtgttttccgttctagatcgcgacggccg

SEQ ID NO: 7806 - DNA, 1397 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatatattaccttagcctcctgagcagctgggattacaggccgtgccaccacgcctggctaattttgtatttttagtagagacagggtttcaccatgttggccaggctggtcttgaactcctgatctcgtgatccacccacctcggcctcccaaagtgctggaattacaggcgtgagccaccgcacccagctggaagtcaatgtagctctaattaaaatcctaatgtgaatttttgggcttcagtcttgcagagaaatattttgaccatcaaatgtgtttactaatatgacaccagtcttcaagtaggtgaatggattgaatttgagaaacaatatttttgtttccttattttattttacttcattttatttttcctaaggtactaaaccattgcttttaaaattctgaagtaatgaagggaataatagaataaaggccagaaaaagaaaatcatcagtt

SEQ ID NO: 7807 - DNA, 2341 bp, Homo sapiens
tggaactgtattcagcggcgacagcggcgactgcggcggccgcgggagggcatcccgttggggatccttccgcacactgaagagtacgtcttcgggtctacccctaatcacataatggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagagagacggggtttcaccatgttagccaggatggtctcgatctcctgacttcgtgatccacccgcctcggcctcccaaagtgctaaaattacaggcgtgaacatacaccacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggtgcagctgctagcaaggaaaattatcttttcatatttaaatctgctagtgaattcaaagaatgacctggctgtggcttatattctcaatattcctgatagaggactaggaagagaagccttcactgatttgaaacatgctgctcgagagaaacaaatgtctatctttttggtggccacgtcttttattagaacaatagagcttggagggaaaggatatgcaccaccaccatcagatcctttaaggacacatgtaaagggattgtctaattttattaatttcattgacaaattagatgagattcttggagaaataccaaacccaagcattgcagggggtcaaatactgtcagtgataaagatgcaactgattaaaggccaaaacagcagggatcctttttgcaaagcaatagaggaagttgctcaggatttggatttgaggattaaaaatattatcaattctcaagaaggtgttgtagctcttagcaccactgacatcagtcctgctcggccaaaatctcatgccataaaccatggtactgcatactgtggcagagatactgtgaaagccttattagttcttttggacgaagaagcagctaatgctcctaccaaaaacaaagcagagcttttatatgatgaggaaaacacaatccatcatcatggaacgtctattcttacactttttaggtctcccacacaggtgaataattcgataaaacccctaagagaacgcatctgtgtgtcaatgcaagagaaaaaaattaagatgaagcaaactttaattagatcccaatttgcttgtacttataaagatgactacatgataagcaaggataattggaataatgttaatttagcatcaaagcctttgtgtgttctttacatggaaaatgacctttctgagggtgtaaatccatctgttggaagatcaacaattggaacgagttttggaaatgttcatctggacagaagtaaaaatgaaaaagtatcaagaaaatcaaccagtcagacaggaaataaaagctcaaaaaggaaacaggtggatttggatggtgaaaatattctctgtgataatagaaatgaaccacctcaacataaaaatgctaaaatacctaagaaatcaaatgattcacagaatagattgtacggcaaactagctaaagtagcaaaaagtaataaatgtactgccaaggacaagttgatttctggccaggcaaagttaactcagttttttagactataaatttgtgtcttatatgctttaggtttatgcatctataaaccattcaccaaagacatgcttaatttttaagagatcaaggtgtaaattatgatgatttattattttggtctacagtgtatgtaaggttagtatgttaagcactgtttttgactttttaaaaataccttagatgcaaatttataggagaaaaaacactttcagataagaggtgtttgctgggatggaagaactacctggcatgtaagaaatatcgtcagtcgtcctaatgcatattgtgactgtttgcatatacttctgtttataaaagtatcagttttacttttcagaggatttgtaagaatcatttaaattttcattgaaataaacgacaagtcacattg

SEQ ID NO: 7808 - DNA, 706 bp, Homo sapiens
gctaaaagacttttagctccaagggaagggaaagtggaagatagattaagtatataatttctgctgcatatcctggggcttgaggcctcatggttatgccccttgctctattcctgctcagcgctgcccaggagacactgtggccctgccccctcttaatgtttggccttcttatggccttcaccaccctgcactctgtggccttggggatgagggtccttgtgacttaccgggttgcctttaggccttaagaaagccaaacaccattttatatttgacaatgtttttgtatgattttataccagataagttaaattttaccattatattaatgtgctattgatgttcaacttaattttaataaaatcttgtagacattatttatccaattttaatgtctaactataaggtaagacttttatagattctttaactttttataatttttgttaaagagcaggttagtgctttaagaaaaatctatagtgattttattgtaatatccagttcacagaaaaactggatgatacccctttaactttagccaatatgttaacacacagaatttcctttacaattaacattttaaaacttgcttaaatctttaaaacagaaaaaaagtttagcctttaatgtaggtaaaaatctgtattcttatgcctctttataatcctgttattaaaagtatttttttacataccttgta

SEQ ID NO: 7809 - DNA, 677 bp, Homo sapiens
ttgactactctagggacctcatgtaagtggattccagagtgaatatgagaagagactgctggttgccaggagctgggagtggggagaatcagaagttgttcatgggtgggcagtttcttttatgcaagatggggagtttctagagatctgctgtagagcttgatgcctatagttcacaaagatggagtatttcttatgcctacaacttaggacaaaaagtgttttgcatttctttcattttttgattctgaaatatttgtcatatacttactggttaagcatcccaaatctgatagattcaaagtctaagatgcttcagtgagcatttcttttcagcatcagattagtaggcataagtgggaggtgataagccaaagatattcttgcccttttttttctctcaccacgtttctagcttggtgattagttttcggtgaattccatactggccatgctgcacttgtatatttttgaatgccttggcatgtgagaaaggctgattgctattttctatgtcatgagaactttccaccttttcatggttgcatctttttctcagtgtttttgttgtggcagtcattaagaagagcctgtcagctcagatttaggacagagttttctaattctgcaaaaaatgttactgggatgctggtaggggttgcattgaatctgcaact

SEQ ID NO: 7810 - DNA, 329 bp, Homo sapiens
gagtgcgatggcatgatcttagctcactgcagcctccacctcccaggttcaagcgattctcctacctcagcctcctgagtagctgggattacaggcgtgcaccaccatgcccagctaagttttgtattattagtagagatggggtttcaccatgttggtcaggctggtctcaaactcctgacctcaggtgatccacccacctcggcctcccaaagtgctgggattataggcgtgagtcaccgtgcctggcctatagtagccactgttgattcatccacattcagctcacatccaacagcaccataattcacccctgaacggagctttcc

SEQ ID NO: 7811 - DNA, 954 bp, Homo sapiens
atggtaatgaagcatcatataataattagcagaccaagaggtattgaacttcacaaattactatttatgtcattttaactgagggtttttctccctctctataattctgttatgctgtttggttaattaagaagtgctaattctaagaacattaagctatgccttcaaaatttcaaatgacctgttgataataaaatttagcataagaaggcatctttgacctttgatgatcattgttttcaatttctgaaggaggtaacggaatcatgaattcttttggctatatcttaatatgaatcccaagcatgcataacaaagtctacttgctgaggacatttggaatgttatttaatcgatgatttttttggtatgctcaattttgatcttactgaaatgtacacagggttacagttcccgagtacttctgtcttctgtttgtggtatgctcaattttcatcttactgaaatgtacacatggttacagttcccgagtacttctgtcttctaacattacagaggtggtgtattcacttttcctttattaatatagacattaactacttggtcccctaatatttttactttagaagattccaaatttacattaaatagcatggaaattatcttcatttcatgtgtttaagttgtgtgccttttcaaatcaaaaagggataacatttagggtgggggaaggataacatattctcttcaaaacataagtgaagaaaaactgtgcgtgacacagcaattaaagaagatgtaaggaaactgttaagataacacagcattcaatttgtcaatcattttcaagggaaaaaattcaagcaaatgggttccaaaaatatattaaaaattagagttcttttagagttttaggaaatacaagaaagaatccccacttagttgcagagacagaattgttcctttgtgcacctagtgagtttctaagaaaaa

SEQ ID NO: 7812 - DNA, 448 bp, Homo sapiens
cagactagcctgggctactttacagttccaaaaccagcaagagaaaagtttctatgtgtagtcacttttctagtctctgcttgtgtcacatttcctattttttcattggtcaaacaagtcactttactaagccaagagtcagtgagggaggtggctgagggatggatggtagggacttaatatagaccaagctaggcggggcgctgtggctcactcctgtaatcccagcacttcaggaggccgaggcgggggggttaacgaggtcaggagttccagaccagcctgaccaacatggtgaaaccccgtctctattaaaaatacaaaaatgaggccgggcacggtggcccatgcctgtaatcccagcactttgggaggccgaggcgggtggatcatgaggtcaggagatcaagaccatcctggctaacactgtgaaaccccgtctctacta

SEQ ID NO: 7813 - DNA, 682 bp, Homo sapiens
cttcattttttttttttgtctgcattctctaccatcaatagatacgaactccctcatggcagagatatttgactactctatgctaggtgcctagaaaaatacctagcatataggtattgagtgagtgctcaataaatcttttgttgaataaatgaatatctgtgtgtctgtgggtgtgtattgggaagggatgaagaaaaggaaagatgaggccacagttgtgatgtggaaagatcacatgtttgtgtataaaagaagtaggacactaacttgagcttctagagacaggttattaccttaggccaagattgctcattcttgggaaagagaagagacccaacaactttctacgtatgaagcagggatgtgaggacaaggtccaacttgaatgtgaggacaaggtctaactgtaaatcaccaaacaaaaaatgtctcccttaatagctccttcacaccacaggaaatggtgtcttctagtccaatcctcttctttttatttatttatttttgagacagggtcttcctctgttgcccaggctggagtgcagtggcacaatcacagctcactgcagccaagacatcctgggctgaagcaatcctctcacctcagcctcccaagtatctggaaccacaggtgcacaccaccacacctggctttttttctatttttctgtaggtcttg

SEQ ID NO: 7814 - DNA, 453 bp, Homo sapiens
gtgttagccaggctggccttcatctcctgacctcatgatccacccacctcagcctcccaaagctggattataggtgtgagccaccgtgcccagcccaacctggtctttagtaacagcaaggacacagaaaactagaaggataatgagttatatttggtaggtaatatatacctgactgactggatttggggatgggagtggaggtaatcattgatacgctgatgccatttaccaatttaagaaatcctgtagaaggatcaaagttaaggggtaaaaagttaggggcttcagatcatacaactggagatattctgtagtcagctggacacatggatctggagctcaggaaagagatctagaataaagatttctatttattatggatggcaactaaagcaatcaaagtgaattcaaagtggccagagaataagtagagaagacaaagccaacatc

SEQ ID NO: 7815 - DNA, 465 bp, Homo sapiens
agtctccactggcactcagctgaatactgaccagcacattgtgcaagaaaactacttaaggtcagtgaaaaggcctttcctctttaacttttcgaattagaggaaacatgtctggtgctcacccatggccagggatagtgcctgttcccaccagctaagactggaaaaatatttcatggggcattgggtatgatacagagtagggggtcttgcctctgtagtagggaatgatcagccttagagtgagcactgcttcagccctacctgagtgtttacaggaatatacaaatacccaacatccaacaagatgaaattcacaatgtctggaacccaataaaaaattactggctgggtgtggtggctcagcctgtaatcccagtgctttgagaggctgaggtgggttgattgcttgagcctaggagttcaaaaccagcctgggcaacatagtgagatcctatctctaca

SEQ ID NO: 7816 - DNA, 490 bp, Homo sapiens
tgaaaaaatccttacaagtatatcagtagagaggttcatttacaggaacagaatgaggaagtgtgagttacattgtcttttgaattcctttatctcgtctgttgtatatattaaacaaatagctctaactaaagatttccttcctccagcttcgaagctgaccgtagagtacccaggttcatagctttaaaatgctgagctaatcctgtgtttatgtaatttctgtttcacatacagttggctttctttccaaacctgagcatttccgtgtcatgctgtagtgacacgatgcagatttacatgcatgatctttttgaatgcattgaagacagaaaactgtgttgcatttgtttaacatgtgtcctgcttgataaatgatacacatagttgctgccttccataaacttgcctgcagctagagttaatgatgggaaagaaaagaagggaataaaaaccacagcatgatttgaacaaaacaagccaaatgaaa

SEQ ID NO: 7817 - DNA, 414 bp, Homo sapiens
ggcccgtccctgggtgcatgtcccacctttctgttcacctgagacaggcattccagtctaagccaggccttcctcacgctgagggtctaaccaaggctccatcaaaagacattggcccagcggtggctcatgcctgtgatcctggcactctgggaggctgagcggggcggatcgcttgagcccaggaggtccaggctgcagtgagccgtgacccagcccctgcactccagcctaggccacagagcgagatcccgtctcaaaataaataaataaataaaaataggccgggcgcggtggctcacgcctgtaatcccagcactttgggaggctaagaggcgggaggatagcttgagcccaggagttcgagacctgcctgggcaatatagcgagaccccgttctcacaagaaaaagga

SEQ ID NO: 7818 - DNA, 442 bp, Homo sapiens
gaaaagctagatgtacagagagatgaagaacagcaaggcaggaagaggggcagcaaaaagggaggctcatcagagtgagggagaggaggagggatttgcagccaggacagacagagcagagtggtgctggtggcaaggagaacagaggaagaacaacagcagggaacacagctgggaatctagggtgccagagagtgggtacagaggggtataacagggaagagataatttaacagggagaaaagaggaggtgcagagatgggagaagaggtggaaatatatggagattgaggatgattgaaagactggggagaaggaggaacaagaggttatataagttccaaggatgaagcagaagaggtggaagagaaggaatagaggtaagaagggaataaacagcagcagaagagaggggtacagaatgaggtgcagaatcccaggg

SEQ ID NO: 7819 - DNA, 460 bp, Homo sapiens
ttcaggataaaatcacagcttcggccaggccagtggctggacacctgtaatcccaggactttgggaggctgaggcagaaggattgcttgagtccggtagttcgagaccagcctgggcaacatggtgaaaccctgtctctacaagaaatacaaaaaatcagccaagtgtggtggcagacacctgtagtcccagctacttgggaggcttgaggcaggagaatcacctgagcaccagaggtggaggctgcagtgagctgtggtcacactcctgtacaccaacctgggtgacagagcaagaccctatcttaaaggacaaaacagaaaaatgggagtgagaaaaaatacacttctaaaaaatgttgtatatgcatgttttaaaagccacccatctgtatactgatgtatatgtgtttaaaaatctccagaaggtaacagaaaactgccagtttttttgagggagt

SEQ ID NO: 7820 - DNA, 397 bp, Homo sapiens
tgagacggaatctcgctctgttgcccaggctggagtgcattggccgatctcggctcactgcaagctccatctcctgggttcacgccattctcctgcctcagctacttgggaggcttgaggcaggagaatcacctgagcaccagaggtggaggctgcagtgagctgtggtcacactcctgtacaccaacctgggtgacagagcaagaccctatcttaaaggacaaaacagaaaaatgggagtgagaaaaaatacacttctaaaaaatgttgtatatgcatgttttaaaagccacccatctgtatactgatgtatatgtgtttaaaaatctccagaaggtaacagaaagttgctttgattcttcctcaaagtattttaaaatcagctacagttccaaaa

SEQ ID NO: 7821 - DNA, 382 bp, Homo sapiens
gttgggggtcgtgtgtgctcctgtccctctggctgctagggagcccagcctcctctcgaagtgcaaggaaggggtccgaccccacgctgggttttggctcctgtccctgggccacacgtgggcctgctgttgtttattatttttatttgttgagacggggtcttactctcttgcccaggctggagtgctgtcctagctcactgcagcctccacctcccagacttaagcaatcctcccacctcagcctcctgagtacctgggactacatgtgcacacaaccatgctcccatgctcggacttttttttttttttgatggagttttgctcttgttgtccaggttggagtgcagtggtgcgatctcagctgctcactgcaaccccc

SEQ ID NO: 7822 - DNA, 2315 bp, Homo sapiens
cgtcggcgcaggcgcgtcgcggcggcaggggcgcggggcttctggaggcggcggcggtggccagcgcggcggcgccggccgtattctccgggctgcggagggtaaagagcgggctcgggccgaggctggagggctgggtggggccagagcggcgcttcgggggcccgcggaggacgagggagggagagaatctgaggagctgggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7823 - DNA, 2188 bp, Homo sapiens
taggctgggtgtagaatcggccgagggtgtgccagctgcggtgtggcgccggccgtattctccgggctgcggaggggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7824 - DNA, 2214 bp, Homo sapiens
cgtcggcgcaggcgcgtcgcggcggcaggggcgcggggcttctggaggcggcggcggtggccagcgcggcggcgccggccgtattctccgggctgcggaggggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7825 - DNA, 2609 bp, Homo sapiens
taggctgggtgtagaatcggccgagggtgtgccagctgcggtgtggcgccggccgtattctccgggctgcggaggggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggtaagtggggaggtgggggagctccctgggcttcccgccttggccttctcgctggggtcccggggggccttcagcatttaaggcttgtggatgtgacaacccccagtggctggggagggtccccagaggagtgagcctgtgtggcgggggttgggtcctgggcgtgggatgtccagcacccgacagacctggtggcatccttggctggtgtgtgtccaacggggctgactcctggggccagggccgcagcgtttttctcgagagagcactctcggctttgcgtcgggctgggcagtctccgtcacgaggcgttgactctgctgccggatgagcccctgaacctcagttcacactggcaggtgggggctggcggggctgggtggcatcgcggggaccccgctcaggcttccctccttcctaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7826 - DNA, 1943 bp, Homo sapiens
gtgtctggctctcaggaccccagtggatgggacgcagctgagacgtctgcagccatcccaggatgcgcagctggcgggagcacacggggcacaggagcctgtcccggcaatggctccttgtctccggcccaagcgacccctggcatggcggacagagaggcccaggaggagccggcctcagggaggatggcttgaggagacaagccccaggacgcagcctgaccccaggacacggcctcgccacaggacacggcctcaccccaggacacggcctcgccccaggacactggcgagtgtttggactttgttgaaactgcgccacaggcactgccctgggaggtaaataaccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7827 - DNA, 1794 bp, Homo sapiens
ggaggcagacgctgttggggcctctcactgccgggctgttgaccttgatcctttggctaaggtgttggctcgggctccccactgcagttaccctcccctcggcgttactgagcactgggggctttcgggctctgcgtctgcacagatacttcgagtctccaaggagacttctgcctgttcatttctgctgctgtcagtggcggggtgggggggtggattttgaatgcctcttgggtggtgtctgggatcgttgcaggaaggttctaagggctcaggagtgtgagtggcccaggcacctgccgtcagcctgtcttctgtgctccgcctgtcgtgggcagccggagaggcggcgcggccgtggtgggagcccaggaccccactgagcccccacgcctgtctcgcagcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7828 - DNA, 1860 bp, Homo sapiens
tgataatcagagagttgtatgactcctattgatgatggttgtgagagccaggtgtcctgtacctgctgcctagcgaatagcgacagatgactttgagacgagctgcaacgatttctaaagacatactactgaacgcgtgtctggtaccgtggctcttcgtatttgcatacagcatgacttcgcaacatggaacggagtcttatggatgaatgctgagcagatgaacgtggccagacccacagaactcatggctgcactcgaactctggtgttctgttgcctccatccgatcggacgtgccgggcgataccgtacgtgtcttcgcaaccatcctatcggtgcaccactcgagagcatcgtcgagtcgcacttcgcagatgagtcgaaatcactaaaccgctaggcgctggcatgggagatggtgggagcagtcagtatgcattcacttatatggtcctgactgatgcttcgccgtgactggttccgtactaccttgtgtgagactcttaccaccatctcagatgtgactgactcagttcgagcgaggaacgtgctatgcagaacaaggtcgcagttgatgctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctctacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7829 - DNA, 576 bp, Homo sapiens
taggctgggtgtagaatcggccgagggtgtgccagctgcggtgtggcgccggccgtattctccgggctgcggaggggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagactccgggtgatcctcatagacgtcgaccgtgcagtgcatg

SEQ ID NO: 7830 - DNA, 354 bp, Homo sapiens
ggtcgagagcgactcattcgttgtcggcgaaggagggtccgtgttttgccgaaggcgtctgattgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagataaaaaaa

SEQ ID NO: 7831 - DNA, 560 bp, Homo sapiens
ctgggagggtgggcggccccacgctgcgctgacccttgcctcttgtctgtccccaggagcatcggtgtcatcacctatatcctgtgagtacctggcgggggccccctcggctgtgcaacacagctggcatgggtccccggctccgtgtgtctcatgtggacgccaggggtccccagcctggctgtgacccatcgcgggtactcaggggataccgggtgaacggatgagtgattctctgtggctgctgtcacagaggcttctggagagttctgaaggcaggacactcacagagcggctgagcaggctccgggttgggggtcgtgtgtgctcctgtccctctggctgctagggagcccagcctcctctcgaagtgcaaggaaggggtccgaccccacgctgggttttggctcctgtccctgggccacacgtgggcctgctgttgtttattatttttatttgttgagacggggtcttactctcttgcccaggctggagtgctgtcctagctcactgcagcctccacctcccagacttaagcaatcctcccacctcagcctcct

SEQ ID NO: 7832 - DNA, 402 bp, Homo sapiens
aagtgattcagctagctttgaggcagtgttttgtagtgagtcattctttgagtcctgaatccttttttttagcctcaaaatatcaatgagatacgcatatcttatttggagtatattattttctaactgtggtcttttagtttaaggaacaacagactgtttgaatgatccttacgatgtttgaacatgttaccggctggaatcccagaaaatatcttggcatgcctttgaattttgagagcccattttattgtgggtgctctggtttaatcccaaatacacaaaaaccaattaaatataagcactgaatttgcaaaggccaaataaacgcaagcacagatgggaaaataaagtacccacttaccaagaaggacgataagaagccttctccagaagtagtta

SEQ ID NO: 7833 - DNA, 310 bp, Homo sapiens
acacacacacacacacacacacacacacacacgaaaatttagtttatttcccattggataattgaataggtctgtttgcttttggtacttgctgatctttccagaagtatactattaggccctgagaatattaaggttacttatggtgagttggaaaacattgttggaattaaagcactttaaatggaaaccatcagtgtgcatccaatattctcccgcccgcaaccaggtacacagattagaaataaaacgtagttaatgtcatatttacttatttaacccgtgctaagggaaatatcacagttttcta

SEQ ID NO: 7834 - DNA, 331 bp, Homo sapiens
ctgttttgcctgggcctggagaacccaagaagacctgctttgctggacaggtgcttgcaaagggccagagaataaacactgtaggctttgggggccagatggtctctgttgagactactcaactctattcttatagtacaaaagcagccacaggcaatacataaaagaatgagtgggctgtgttccaataaaactttatttataaaacgaaaagggggccggacatggcctgtgagcagacaaccggagctcatgcctgtccccttcagtccccataagcaggccttcccgtatctctccgtaaaggaaaatgggaagcagaccagaagta

SEQ ID NO: 7835 - DNA, 247 bp, Homo sapiens
caaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctgggcaacaagagcgaaactccgtctc

SEQ ID NO: 7836 - DNA, 419 bp, Homo sapiens
aaatgattaccagtacttaacacacacaacacctgccaggtgaaacactcaaaactaagtctcaactttttaaagatgctttaacatctttgagaacttaaatccactccaggcattaaccactcggtatctgcatttgaccacagtatcttgtccattcatttaaaatctacttgtgctagatgctatggatacaagagaaacaagatagatatggccctcctgcattcaaagccttcaaaggaaaaagtttcatcacaataaagagtagaagtggggaactaaatactttttttaaaaagtcaaataaatatttaagaaattcttagtttcaagtattttcagaaaatcaatctggtcttatcaagaactgcctagttgaagccaggcacagtggtgcatgcctgcagtctcagcta

SEQ ID NO: 7837 - DNA, 1384 bp, Homo sapiens
  misc_feature (1)..(1): n is a, c, g, or t
  misc_feature (6)..(6): n is a, c, g, or t
  misc_feature (8)..(9): n is a, c, g, or t
  misc_feature (11)..(11): n is a, c, g, or t
  misc_feature (43)..(43): n is a, c, g, or t
ngcacngnncngagactcgcgccccccgccggatccccacctncgcgcccgccccgcgggctgagctgcccgaccggggcccgcccccggcgcccaccatgtacgcctttgtgcggttcctggaggacaacgtctgctacgcgctgcccgtgtcgtgcgtgcgcgacttcagcccccgctcgcggctggattttgacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgaggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaag

SEQ ID NO: 7838 - DNA, 1466 bp, Homo sapiens
  misc_feature (1)..(1): n is a, c, g, or t
  misc_feature (6)..(6): n is a, c, g, or t
  misc_feature (8)..(9): n is a, c, g, or t
  misc_feature (11)..(11): n is a, c, g, or t
  misc_feature (43)..(43): n is a, c, g, or t
ngcacngnncngagactcgcgccccccgccggatccccacctncgcgcccgccccgcgggctgagctgcccgaccggggcccgcccccggcgcccaccatgtacgcctttgtgcggttcctggaggacaacgtctgctacgcgctgcccgtgtcgtgcgtgcgcgacttcagcccccgctcgcggctggattttgacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaaggattgtctggggaaatattgatctgcagtccaagaaaatcccagctgcccttgcctgaactgattctcgttgtcctacacagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgaggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaag

SEQ ID NO: 7839 - DNA, 1191 bp, Homo sapiens
ggacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgaggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaag

SEQ ID NO: 7840 - DNA, 1537 bp, Homo sapiens
ggacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgaggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaagctttcgtgttttccttgtgtggcatgtgatttgcgagcgatggtgccgtccaaatcagaccccaccgtgcatggtggtgtgtgtgcagggatccatcgggttctggggtcagcggcttgttctgaatgtggacactccaaagaagacagatggctttgctgagactcaggagcagcctggcactggtgtccttctgggaatggggaaaacactcttcttggagggggataaggttgcctgagttgcctgtcacttgactggggtttgaatggatatttttactatccaaggacttctttgttgctctattttgttctataataaattttcattaattctttgatgt

SEQ ID NO: 7841 - DNA, 1520 bp, Homo sapiens
ggacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgaggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaagctttcgtgttttccttgtgtggcatgtgatttgcgagcgatggtgccgtccaaatcagaccccaccgtgcatggtggtgtgtgtgcagggatccatcgggttctggggtcagcggcttgttctgaatgtggacactccaaagaagacagatggctttgctgagactcaggagcagcctggcactggtgtccttctgggaatggggaaaacactcttcttggagggggataaggttgcctgagttgcctgtcacttgactggggtttgaatggatatttttactatccaaggacttctttgttgctctattttgttctataataaattttcattaattctttgatgt

SEQ ID NO: 7842 - DNA, 1388 bp, Homo sapiens
ggacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgaggcttggcagcggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaagctttcgtgttttccttgtgtggcatgtgatttgcgagcgatggtgccgtccaaatcagaccccaccgtgcatggtggtgtgtgtgcagggatccatcgggttctggggtcagcggcttgttctgaatgtggacactccaaagaagacagatggctttgctgagactcaggagcagcctggcactggtgtccttctgggaatggggaaaacactcttcttggagggggataaggttgcctgagttgcctgtcacttgactggggtttgaatggatatttttactatccaaggacttctttgttgctctattttgttctataataaattttcattaattctttgatgt

SEQ ID NO: 7843 - DNA, 806 bp, Homo sapiens
agggggatggggatgttgaatttggaaattggaggggacgctggtggacggattgggtgcaaggagttggtgttgatggaggagcaggacgccagagtcccagccctggaaccgttcagagtggagcaggttgtcagaactcagggtgcagagggtgaaggaggcaggctgattcctgagttcttgggttgggactgcccccttccaccaaattcattcttactgtcagagtccattctggaatggcactggtcccttgactttagaccctgacctgtctgaggacatcctgagcctgtctccaggcataggggttgctctgtgatgatatgtcctctgtgtgggttgaagggccacaccttcagggggtctttctatcctaggcaccacctgtaatctactatgtccctgacttcatctccaaagaagaggaggagtatttgcttcgacaggtgacctcagtgccctactggtctgttttcccactcttcccatattcctccccaatgtccatcctctgtatgagagcccccaaggctgcagtgaagaccccgacagaaggaacaaggaagttacagagctcatactccctctactgagatagcccaatcctgctagcttagagaatagggggttataaacataggctgagatagcccagttcagatcattgagactggggagtaaagaattttgtattcagatttctgtgctgagatagcccagtaaactctttcctgtgctaaaatagcccagcatagacccagagcacaataaggttaccaaatacagaccatctacgctga

SEQ ID NO: 7844 - DNA, 961 bp, Homo sapiens
agggggatggggatgttgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7845 - DNA, 1002 bp, Homo sapiens
cgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7846 - DNA, 1244 bp, Homo sapiens
cgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggtaaccacacaccctcggcccgtgtccccccactcagacttctgagctgtgctggggcaggggactctgtacccaccctcactcattaggcagccacatctcccaaacaggcattcacctccctgtccctggcttgggaagcccccctttgacccagagggtgggggttgtggactcctgccctgcccagccctggtgcccactccctagccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7847 - DNA, 1137 bp, Homo sapiens
ggggtcagtggaggtcctgagggattagggatttcctgatgagttgggagtatctgaaagggacctgtggtctggagaagtgaggaaacctctgaaggacccagtggctatctccaaacggtcaggggtccctgagaggatcagggtgcttccagccactgtggaatccctaatgggggatctattgctataggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggtaaccacacaccctcggcccgtgtccccccactcagacttctgagctgtgctggggcaggggactctgtacccaccctcactcattaggcagccacatctcccaaacaggcattcacctccctgtccctggcttgggaagcccccctttgacccagagggtgggggttgtggactcctgccctgcccagccctggtgcccactccctagccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7848 - DNA, 829 bp, Homo sapiens
agggggatggggatgttgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtgacctcagtgccctactggtttttaatgccccaaagccaaagtggacccagctctctgggagaaagttacagaactgggccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7849 - DNA, 800 bp, Homo sapiens
cgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctatgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7850 - DNA, 580 bp, Homo sapiens
agggggatggggatgttgaatttggaaattggaggggacgctggtggacggattgggtgcaaggagttggtgttgatggaggagcaggacgccagagtcccagccctggaaccgttcagagtggagcaggttgtcagaactcagggtgcagagggtgaaggaggcaggctgattcctgagttcttgggttgggactgcccccttccaccaaattcattcttactgtcagagtccattctggaatggcactggtcccttgactttagaccctgacctgtctgaggacatcctgagcctgtctccaggcataggggttgctctgtgatgatatgtcctctgtgtgggttgaagggccacaccttcagggggtctttctatcctaggcaccacctgtaatctactatgtccctgacttcatctccaaagaagaggaggagtatttgcttcgacaggtgacctcagtgccctactggtctgttttcccactcttcccatattcctccccaatgtccatcctctgtatactaatctccctacaaatctccttaattataacattcacagccacagaacaccgtca

SEQ ID NO: 7851 - DNA, 993 bp, Homo sapiens
agggggatggggatgttgaatttggaaattggaggggacgctggtggacggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggggggccctcaggaccccattgccttccccaggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7852 - DNA, 1212 bp, Homo sapiens
cgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatggtaaccacacaccctcggcccgtgtccccccactcagacttctgagctgtgctggggcaggggactctgtacccaccctcactcattaggcagccacatctcccaaacaggcattcacctccctgtccctggcttgggaagcccccctttgacccagagggtgggggttgtggactcctgccctgcccagccctggtgcccactccctagccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7853 - DNA, 964 bp, Homo sapiens
cgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttggaggcctcccagctaaccatgtcctcgtgaaccagtatctgcctggggagggcatcatgcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7854 - DNA, 850 bp, Homo sapiens
cgggcatggaacgtaggggctctctgtgtggcttgtaagatgctgaagactcagattttagagaccaagtgcgtttcagaagagggctgaggattgggtgcaaggagttggtgttgatggaggagcaggacgccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactgggccccacgaggacggaccactgtactacccgactgtcagcaccatcagcctgggctcccacaccgtgctggacttctacgagccgcggcggccagaggacgatgaccctacagaacagcctcggcctccgccccggcccaccacctcgctactgctggaaccgcgcagcctgctggtgctccgcggccccgcctacacgcgtcttctccacggcatcgccgccgcccgcgtagacgcgctggacgccgcctcctcgccgcccaatgcggcagcctgcccgtcggcgcggccgggagcctgcctggtgcgcggcacccgggtctcgctgaccatccgccgcgtgccccgcgtgctgcgcgccggcctcctgctgggcaagtgaccgccagggccgggacccctcggattcccaggttcctgcccctttggggctgctgtgactccgcgacctaggaaccgtgggcaaagggggctcccctgggttatttattttcccaataattttgtgtgagctacagaagaccccataccaaataaacaaaaaaatcttt

SEQ ID NO: 7855 - DNA, 190 bp, Homo sapiens
ctcccacaccgtgctggacttctacgagccgcggcggccagaggacgatgaccctacagaacaggtgggcccccagacactgccccagctgcttgtaggcacttcaacctcgcacatcctccaagatgacctggtcccacatgccttcggggtactcctggcactctcccagataccttcccttgtcccc

SEQ ID NO: 7856 - DNA, 372 bp, Homo sapiens
aactgacaagatggtcgcgggtcgccgcgtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccccccgtttgctctgggcaaaacttcgagagttccctctgaagctggagctttttcctcagatccaagatccaattggtcac

SEQ ID NO: 7857 - DNA, 168 bp, Homo sapiens
tagcatattaaggctctcttaagcttgagttaatatcgaaaacagtactgtggaactgacttaatctgcttctctctgtgcatgcttcctttattatttctgaagactttaattttttttttttttgagacagggtctcactctgtcacctaggctggagtgcagtgg

SEQ ID NO: 7858 - DNA, 963 bp, Homo sapiens
atccacactggaagaacaagatttggtttctgaacattgggtcttagtccttaaaataacttgcaacctgttacctcttcacttactcccatcgccaccacaagaatcctgtgtgtttttgttttgtgcatccagtctaaaacgggtctgcttttattcataggcttttgttttcagtggtttttgttgttgcatttttccctagataaaatgttttttctataagacactgcttaaaagagtccaatgcagtatgaatttgtatttgtgtttaacttttgtgcttaacagatctgccatggctgaactctcagttgcttaagcaaaattctggggcttattctaggttcctttatttgtcattgtcactcccattccagttatcagcaaattccatcagctgtctccgagacatcttaaatctgtctacctccctccatgtccactgctaccactctgcccaagctattatcatctttcacctgaactcctgcactaatgtctgctgtccttgcatccactcctgccctcctacaatcactgacggcagccgcagggatctttataaaacgaaaatcagataatgtcacttccctgcttaaagccctttgagtggcttcccattgcacttagaaaaaaaaaaaaaaaaaaaaactggccaggtgcgatggctcatgcctgtaatcccagcactttgggaggccgaggcgggcggatcccctgaggttggtagttcgagacctgcttggccaacatggagaaaccctgtctctactaaaaacacaaaattagtcaggtgtgatggcgcatgcctgtaatcccagctacttgggaggctgagtcaggagaaacgctcgaacccaggaggcagaggttgtggtgagttgacatcacgccattgcactccagcctgggcaacaagagtgaaactccgtctgaaaaaaaaaaaaaaaaacccaaact

SEQ ID NO: 7859 - DNA, 432 bp, Homo sapiens
ggagggaaacagattctgcagtttaagtctagaccaattatttaaaaactcaaactctgaaaaaaaaataataaatctagagttactgttaagggttccatattcaaccccaaactgctagacatggcaaagaaaagaaataccaggaaaatgtgagtcatcatcaggaaaaatagtcaataaaacggactctgactgggctcagtgttggatttaatgaagacttcaaattggctatttagaatatattgaaagaattaaaggaaaatacagtctgggcattgtgacatgtgcctgtagtcccagctacacaggaggctgaggtgggaggattacttgagcccggtagttcaagactatgatcacacctgtgaatacccacatcagtctagcctgggcagtaaagaccctgtttctttcaagaaaagaaaa

SEQ ID NO: 7860 - DNA, 1750 bp, Homo sapiens
gcggccgcggccctggcattcgcgcttgggtctggagatagcgcgagagactcaccggctcctgggaacccagtcgagggcccgggccaggggcataagaggaagttgtcccgagtggctcgcctctggccctgggagaggcggccccgggagccggcgtcccgcccccggcggcctcattccccgaccctcctccccggctgcgcgcgccggccctggctgtatctcgggggctgcggcgggaactgccgagcgggcttgactggacgcactgcctgaggacctgcggaggagacgagggagcgcggcgggtcagccccgaggttaggccgcgggtcccctgtccgtggcgctccgtccttttcccagccgtcttggctacagaatctgcgacctccccacactccttctcttttgagtatgtcacttaagtcttctcgccggatgctttttcctccttgcttttgccggaaaggagagagatacatgtgaaggatatctgtcctcgttgcttcccctgccctctcaaaagtttaacttctgtgggaatgtgtatcttccttttctggaccatttgacagtcccgccccagccgccgtgtgatttagcaaccggtatcatattcagatcaaatcttaaaaaaaaaagtcacctacagaactacagaattgttctctcccgctcaagaagggcaagtggactttggcgttaagatgcaggggggtgaaccagtgtccacaatgaaagtctcggagagcgaaggaaagctggagggccaggccacagcggtgaccccgaacaagaacagcagctgtggaggtggaatcagtagcagcagcagcagccgcggtggcagtgcaaaaggctggcagtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggtaaggtaatataaaaatatgat

SEQ ID NO: 7861 - DNA, 902 bp, Homo sapiens
gagcagtggagtgaacaggtggtgtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggtaaggtaatataaaaatatgat

SEQ ID NO: 7862 - DNA, 396 bp, Homo sapiens
gtgcttccaggcctgtaaggaattcggtgcctaaccattcggtgataattagctaaccacactgagacttcaatggccacacctgaaagagaagacagactttacagaattagtccaagaaagtcactgaacaaaggaacagcagcagcagaagcaacaccacactgtggggcaggacatctgatttccagagttgccacattattttttaaattgtctgattttcaagaaaaaaatatgtaacaaagaaacatgacggtatccgttactaaacaaagactttaaatctgctgttataaaggtgcaccaagaactaaaggaaactgaaaaaattaaaagaaaatgttagagtaatgcctcaacaaataaagaatatcagtaaggagagagatatta

SEQ ID NO: 7863 - DNA, 316 bp, Homo sapiens
aaattaaaatttcttctggatttttaaaaccttatccaattagacttaaaattcttattacaaatgtctactatgtaattagtatgtaatctcaacattttaggaggctgagaaaggaggatcatttgagaccaggagttgaaaaccagcctgctcaacatagtgagaccctgtctctacaaattaaaaaaaaattagccagatatggtagaacttgcttgtagtcccaactacttgggaggctaaggcagaggatcacttaagcctaggaatttggggctgcagtgagctatgattgtgccaccacactccagcc

SEQ ID NO: 7864 - DNA, 239 bp, Homo sapiens
catcatctccctgaaagctcagtcaaccctgtgcagcgctactgccacactccccttttgcacatgtagaaatcaaggatctgtggctcctctgagtgacttgttcaaggtttctcagtttccaagagatggaggcaggacttgaattgagatttccctttcttgagaacctgtggtccttaaccattaaaaccacttaagaggtcttctctcttgatcactacctactaagtgctagg

SEQ ID NO: 7865 - DNA, 402 bp, Homo sapiens
aaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatc

SEQ ID NO: 7866 - DNA, 271 bp, Homo sapiens
catagagtgaaccaatgagaaaccttcatttgtatagactgaagcagtgggaaaccttcatttgcatagagtgaaccaatgagaaaccttcatttgcatagagtgaaccaatgggaagctgtcatttgcatagagtgaagcaatgggaaacctctagagggtatttaacccagaaaattctgtgacagatgttcttgagccacttgctcaaccctgctcccactgtggagtgtacttttgtttaaaataaatctctgcttttacttccttc

SEQ ID NO: 7867 - DNA, 365 bp, Homo sapiens
gtcgacctgtactccagcctggatgacagaggaagaccctgtctccacagtaaataaatcaatggaacagaattgagagttcagaaataggttgggtgccgtggctcgtgcttgtaatcccagcactttgggaggccgaagagggaggatcacttgaggccagaagtctgagaccagcctgagcaacatagcaagaccctgtctctgcaaaaaaataaaaataacccaggcagtgggttgtgcctgcagtcccatctgctcaggaaggtgaggtgggagaattgcttcagccaggggtttgaggatacagtgagctatgatcataccactgtactccagcctggatgacagagtaagaccctgtc

SEQ ID NO: 7868 - DNA, 455 bp, Homo sapiens
tttttttttttgagacagggtccgtcacccaggccatcacccaggctgcagtgcggtggtacaatcttggcctaatgcaacctccacctcctgtgctcaagtgattctcctgcctcagcctcccgagtagctgggactacaggtaggcgccatcatgtccagctaatgttagtattttttgtagagacggggtttcgctatgctgcccaggctggcctcaaactcctgagttcaagcaatccatctgcctcagtctcccaaagtgctgggattacaggcgcgagccaccacaccaggctgattactagtttaagaagctggatgatcaattgcttcaagttttttacttcccttccatatttcaagcaaaacactttttcaagtctttgaggaattcctaaatttataaaagctaacaacaaaatacattctcgatccatataacacagcctcgt

SEQ ID NO: 7869 - DNA, 410 bp, Homo sapiens
acatgggttatggccacatgtccctctcatctctgttcactaccaggttaaatctttctgttcattgcctcttgctgagagtgtatctcagcctaactaatgtctacattaatatttaccaaagaactgaattgtctagttgtttatattctcatgaaaataagatgaggtttgtgggttagcctagcagtgaatggaaatttattaggcttaaaagccaggaaagaatagagacaaattgtaacctccagtctctccctcaggtttccacaatagacatcagtaattaataatgccactcagaatccttcttgacacagtggtcttggcaacaattgttgaatgatcagagagggcaggccagttagaacctatttgccatctttatgtcagtgtctgatgtaagttaa

SEQ ID NO: 7870 - DNA, 373 bp, Homo sapiens
ttcattaaattaagaagtcaacataataattttaaactaacagttgaataacatacaaaaccaagtacacaataaggaaagacccaaaatctggatcggttatttctcccaaattccattccttaagaaattaagtgtttataggccaggtgtgggctcacccctgtaatcccagcacttcaggaggctgaagtgggagaatggcttgagcccaggagttgaggccagcctggataacatgctgaaaccctgtctctaccaaaaaaaaaaaaagtgtattttacacacacacacagctacctcttattttttgagatggagtctcgctctgtcacccaggctggagtacagtggtacgatctcagctcactgc

SEQ ID NO: 7871 - DNA, 435 bp, Homo sapiens
aattgttgtgcatgttttttattttctttcataattagaacatgagctattaataggctagattataagctccccaaggctagagataccggccagttttattcattgatgcatcacaggcatctaaaacaatgtcaggaatatagaactgttcaataaattcttgctgaattaacaggaaggtgtatttctctttccattcatgaatctctctaaaactccaaatataatgctaaacacaaatatatgaaaattttaaatgcctgagtaaatgaaaatagatatgtctggtattttaaaaattttaaaaattcaaacaatagagccacaatagacaaatcaactcactggctacagaagtcacttagcttgttcattacatgttctcagtgactctctgtcactgctgtaagaaagatatatggtatcagctga

SEQ ID NO: 7872 - DNA, 474 bp, Homo sapiens
ggaaaccacagaactaggtgagactcctacctctgactgcctgggtgtccttgggcaagtcagctgaccgggccatttccctcagttgtcaagtagggattagaggtgtatgtgctcctactgtgttctctgctccaaggaatcatggcgcagtgctcccagaggtgggttgtgtgttaccatgtttttaacaacgggaagcaaaaactttatttgaactttcattctgatgcttcactgatgacaccggaaatgaagataatttgttttgtgattgttttattgtgttttcaagttttaattcatgaattttcctgtactaaaacaaagagcaaagttggttaaagcctgcatgtaaataaagtccagtgggatttttgacacctgcttgacgtttctatgtctacaaacagtgttgtaatgaatacggcctttcatcattaaacattcgattttttaaaaatgacgtttact

SEQ ID NO: 7873 - DNA, 216 bp, Homo sapiens
gtgtcaactcacgtataaaacagtcacctttacagtatcatcacatttcttagcagaaaccttgcagacgaggagagaatggaatcatatattcaaagtgctcaaataaagcaaataactgtcagccaataaaactattccagcaaagctattcttcggaaataaaggagaaataaaggcctttcctgacaaaaaaaaaaaaaaaaaaaaaaagca

SEQ ID NO: 7874 - DNA, 645 bp, Homo sapiens
agagaggaaagaaccctgggaacgggaggcgaagggataatgagctggggatgggagcagtcgcaggaagaatcctctgcctggagccggcagactccaacccctcagcttgagactcaggagccccatagtccccacagcaataagaagcaccagctcctggtcccgaaaaaaggagggccccaactccagggactgcggcccgccctggagctgagaacacgcggactccagggagaggacagggcttcagggacccgagagccgctctgagcaccgggggatgtgactgcctcagcggcagagctggaagggccctcgaatgccattcacaggaacagcccaggaacccagggacttcagaagggctggtttgtccgaaaagtgagaggaggcggaggagagagcctgcgaggtcaagctgcagagaacatgagcttctacctccagatgtgccagggtgcatctcaataaacttggattttggccaggcgcggtggctcaggcctgtaatcccagctctggaagctgaaggatagcttgagcccaggagttcgaggctgcagtgagctatgatctcaccactacactccagcctgggtgacagcaagagatcttgtctcagaaataaataaataaaattta

SEQ ID NO: 7875 - DNA, 270 bp, Homo sapiens
ttcgttccagcctgggcaacagaaagaccctgtctgggggaaaaacaatctggtaggcttccagaccaaaagtaacttttgtagttcgaacaagggcaagagccctgaatggtaagaggaaagagttccatgtggctctttaccattctgagattaagccaaaaatgaagatgtcaacttaaaacaggatatatttgattaacaaatggtttcatggataaaaattcaatgattccgtaagggatattcccttggaacttcaagttggtt

SEQ ID NO: 7876 - DNA, 3607 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaacacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctataaaaaaaaaaaacagacaaaacaacaaaaaaccaaaaacagagcccaacaaaaaaacaacaagccaacac

SEQ ID NO: 7877 - DNA, 3681 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctggtgaggctgaagcagggtaggtcaggatgggacagggcagggcaccaggcactcctgaccctgtctccctgcagacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaacacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctataaaaaaaaaaaacagacaaaacaacaaaaaaccaaaaacagagcccaacaaaaaaacaacaagccaacac

SEQ ID NO: 7878 - DNA, 3410 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaacacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctataaaaaaaaaaaacagacaaaacaacaaaaaaccaaaaacagagcccaacaaaaaaacaacaagccaacac

SEQ ID NO: 7879 - DNA, 2956 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgaggtaagaacccactgggcccacagctatggagagggccttatctctgttcaattctcttaccttctctttcaccttccttcctttttaaaatttccttcattctcttcctcccttcctcatttaacttatgttcattctggaaggaatagtgaggaatgagcagtgggcagtgatgatgtaacaaaaggggacagccctgcagaggtactaacatgggtgatcattcattcctccaacagaatatttattgaacatgtattttgggccaagcattgtcgtaggcattgcagatacatccaggagctaaatatccaaagaccctgccctctcagtgcctgtgttttag

SEQ ID NO: 7880 - DNA, 395 bp, Homo sapiens
gtgtgcatgggtccctgagccttgaaacgcgacccttttccctggacatgcgactactaacttccctggctgacccctgacactgacctctgacctttgacctgtgttttctgaactctgaaccttaatccatgattcataactttgggtactgacccctgacctccagttctggatatgtggctgctggtctcagacgacttacacctgtgacatgggcaagtcacctctaggctggcctgcgtgtcccacccttaccctcagaccaatgagcttgcatcctgtaccctgacctttctcttcacaccatccccagggtggctgcacgatttatggaaaacaagatgtctgccaacaacctgggcattgtgtttgggccgacactgctgcggccg

SEQ ID NO: 7881 - DNA, 930 bp, Homo sapiens
agcctccctagtagctgggattacaggcatgcaccaccacgcccggctaaattttgtatttctagtagagacggagtttcaccatgttggccaggctggtcccgaactcctgacctcagataatccaccaacctcagcctcccaaagtgctgggattacaggcatgcaccaccatgcctggccaagcagtacacttataagggcatcgtctatccccaaacaccaaaactgcaaaggatgacaggtgcacagtcagtggtggtccatgccctgtgcataggaggagttcaatggtagtccacacccagtgcagagtaggtgcaaagtcaggggtggctggcagagccacctgggcccactcctctttggtctcacttcctaccacctttccctcattcattacagggtggggctgcgtcctaacataccaggcatgctcctacctcagggcctttgcactggctattccttttgcatgtccaggaacaagcccttggctctccaggaatctcaaagaactgggattttagtgttggggtctcattcttgggtttctccctgcagattccaactccacagagtgaccagagagaggacgtggctgaagacaccaaagatgggggaggggaaggtgagtatgttagagagaggctcaggagttctgggggtgccctggccccagggtggcttgctaaaagatgactcctggggggatatacagagaacttggaggtgctctgcactgaccacccaccccgtacacagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacat

SEQ ID NO: 7882 - DNA, 3538 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaacacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctata

SEQ ID NO: 7883 - DNA, 3542 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaacacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctataaaaaaaaaaaacagacaaaacaacaaaaaaccaaaaacagagcccaacaaaaaaacaacaagccaacac

SEQ ID NO: 7884 - DNA, 2862 bp, Homo sapiens
cgtggcctccgctgggcagggcgacgcggaaccgaggcggcggcggcggctgcggcggcaggaaatcggggctcggccccgccggcgcgcgaccccatccccatcccggtccctgcagagcgatccccgggcccagatatggacgcagcagagccgggactccccccaggtcctgagggcaggaagaggtacagtgacatcttccggagcctggacaacctcgaaatctcactggggaacgtgacccttgagatgctggctggagaccctctactctcagaagacccagaacctgacaagacccctacagccactgttaccaacgaagccagctgttggagcggcccctccccagagggtcctgtacccctcacaggggaggaactggacttgcggctcattcggacaaaggggggtgtggacgcagccctggaatatgccaagacctggagccgctatgccaaggaactgcttgcctggactgaaaagagagccagctatgagctggagtttgctaagagcaccatgaagatcgctgaagctggcaaggtgtccattcaacagcagagccacatgcctctgcagtacatctacaccctgtttctggagcacgatctcagcctgggaaccctggccatggagacagtggcccagcagaaaagagactactaccagcccctcgccgccaaacggactgagattgagaagtggcggaaggagttcaaggagcagtggatgaaggagcagaagcggatgaatgaggcggtgcaggcactgcggcgcgcccagctgcagtatgtgcaacgcagcgaggacctgcgggcacgctcccaggggtcccctgaggactcggccccccaggcctcgccgggacctagcaagcagcaggagcggcggcggcgctcgcgagaggaggcccaggccaaggcgcaggaggccgaggcgctgtaccaggcctgtgtccgcgaggccaacgcgcggcagcaggacctggagatcgccaagcagcgaatcgtgtcgcacgtgcgcaagctggtgtttcagggggatgaagtgctgaggcgggtgacgctgagtctcttcgggctgcggggggcgcaggcagagcgtggcccccgcgccttcgccgccctggccgagtgctgtgcgccctttgagccgggccagcgctaccaggagtttgtacgggcgctgcggcccgaggccccgccgcccccgccgcccgccttctccttccaggagttccttccctccttgaacagctcccctctggacatcagaaagaagctctctgggcctcttcctccaaggctggatgagaattcagctgagccaggcccttgggaggatccgggcacaggctggcgctggcaagggactccaggccccactccgggcagcgatgtggacagcgtgggtggcggcagcgagtctcggtccctggactcacccacttccagcccaggcgctggcacgaggcagctggtgaaggcttcgtccacaggcactgagtcctcagatgactttgaggagcgagaccctgacctgggagacgggctggagaatgggctgggcagccccttcgggaagtggacactgtccagcgcggctcagacccaccagctgcggcgactgcggggcccagccaagtgccgcgagtgcgaagccttcatggtcagcgggacggagtgtgaggagtgctttctgacctgccacaagcgctgcctggagactctcctgatcctctgtggacacaggcggctcccagcccggacacccctttttggggttgacttcctgcagctacccagggacttcccggaggaggtaccctttgtggtcacgaagtgcacggctgagatagaacaccgtgccctggatgtgcagggcatttaccgggtcagcgggtcccgggtccgtgtggagcggctgtgccaggctttcgagaatggccgagcgttggtggagctgtcggggaactcgcctcatgacgtctcgagtgtcctcaagcgatttcttcaggagctcaccgagcccgtgatccccttccacctctacgacgccttcatctctctggctaagaccttgcatgcagaccctggggacgaccctgggacccccagccccagccctgaggttatccgctcgctgaagaccctcttggtacagctgcctgactctaactacaacaccctgcggcacctggtggcccatctgttcagggtggctgcacgatttatggaaaacaagatgtctgccaacaacctgggcattgtgtttgggccgacactgctgcggccgccggacggcccgcgggcagccagcgccatccctgtcacctgcctgctggactctgggcatcaggcccagcttgtggagttcctcatcgtgcactacgagcagatctttgggatggatgagctcccccaggccactgagcccccgccccaagactccagcccagcccctgggcccctcacaaccagctcccaaccgccacccccgcaccttgacccagactcccagcccccagtcctagcctcagaccccggcccagacccccagcaccacagtaccctggagcagcatcccacggccacacctaccgagattccaactccacagagtgaccagagagaggacgtggctgaagacaccaaagatgggggaggggaagggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctata

SEQ ID NO: 7885 - DNA, 932 bp, Homo sapiens
agtgtccagccaaggcccagaggactcactcctggggacacagtctcgtggccacttcagccgccagccagtgaagtatccccggggcggtgtgaggcctgtaacccaccagctgtccagtctggccctggtggcttccaagctgtgcgaggagacccccatcacatcagtgcccagagggagtttgcgggggcgggggcccagccctgcagctgcctcccctgagggcagccccctgcgccgcaccccgctgcccaagcattttgagattacccaggagacagcccggctactctcgaaattggacagcgaggctgtgcccagggccacctgctgcccggacgtccagcctgaggaagccgaggaccatctctgaccaccctggcaccttaaataaggaagaggcccagattgtgaacacggacccatatatccctacctcccaccacctagtggccaaacaccccgccaggagttcaatgctgggagaggtccagagggttcctataaggaaaaactatttaatacatgacctaggggaggcctaaaacccttttggggataatgtcccagagtccccccactagacacaggtcactgccaagcatcagggccactcgggctcagaggtcactcagggtcaatactcagggtcagtgcaggttatgagatccttggggtccaccctagtctctgacacctgggacaggggtgcttttgctactttggttgtggtcactcccccacacctgcctgcctccttcacggactcgaagtgaccttcctggaggaggtgggcagctcagactccacatgctggtggtgcctgaggtctgatggcctctaataaactgtgtcctataaaaaaaaaaaacagacaaaacaacaaaaaaccaaaaacagagcccaacaaaaaaacaacaagccaacac

SEQ ID NO: 7886 - DNA, 518 bp, Homo sapiens
tgcaaccagcccctttgctgccttctcctggttgtccctcaaccatcccctgggcttggcacagaaagtagggttcaaggggtgcagctgtcacactcctgcctagagccaggaccccccaccccacaccctgccaattacagaattacaccagccagagggctctcacagggtagcagatctatgccccacatttcacagatggagaaactgaggctcagggaaggatagtgactccacagcatcagggctgggacccaggacccctaccttcagcaccagagctctttgcaccccacctgctgcccaacctggttttagttgagattccaagggacagtggcaggtagagaatgaagtttaaatgggtcgccttgactcctgggggaccccagactgtctgcctgcttgtaggggctacttgcatgaaatagctgccccacacctggctctgcccaccccttagctgggctgctgcccgcctcctgtatccctcccttcacaccccatcctatgaa

SEQ ID NO: 7887 - DNA, 325 bp, Homo sapiens
ttgcactagttgctaagaagctgtcagaaaccattagcggttggctaaagtcgccctatggcatttcctcatagcatcagcaaaacgagcataaatcacccactggagcctactgctatcctaatgaggctgtaagcttgtttatggactagcatcatttttatgattatttccaccttttcagtttgccttcatttggcggcaggagaagtcagctccaggaatgaagtcactgctgacattttacaaatgtggttcagagctgctgcctgctgccgtgtggtcggccggcggttctccaagtttgtttagtgatctcaaaagt

SEQ ID NO: 7888 - DNA, 643 bp, Homo sapiens
cttattcttatccatacatgtaaactctttttagagaagcttaataaagaagtagtacacacttgaccaaagaaaggggacatttattttttactatgagattttgcatctaataaaattgcttgtattttcttacaatgttgttcatatggaaccagaacttgttatgtataaatataatgggatgagaatttacatgtttattagaagttttctgatatttataggccaatatatttaaaatatatatattcagaaattggaaacatttaaactgtcaaagagtagataataggttaactaaatgatggtattactctgagagactatagtacatacaataaagacatgctttgaaagtatatatattaatatggaaaaatgaatgttataaaacaacatatgtggaaaaaatgtgaacttatgtaaatatatacttgaagtgctgcaaagtatagaatctctgagtgataggacttgtctttattctttatctgtatttttataaaatctatattttgaatatttatatgtaaagactcgttttagctctataaaattgatctgtagaggtatttttcatctataaaagtaataaagtccagtaaaaaataatatatatatacaatgctatattattgta

SEQ ID NO: 7889 - DNA, 2014 bp, Homo sapiens
cacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaat

SEQ ID NO: 7890 - DNA, 2152 bp, Homo sapiens
cacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccaggaagacaaaggcattctaccatgagagatgtgtccaagttatctagaatgaaacacgcttgcggggagaaaaaaagttttccacagaaatggcaaaaggaaaggagtcaccttaacaaagctgcagaaatcaaccttatgatttgccatctctcttgggtattttagatgctgggatcaccatatcgctgaagggtgtttctgccttccatggaaaaaaatactcatttttgaaaagaggcaagattcccaaaacgaaagacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaat

SEQ ID NO: 7891 - DNA, 2288 bp, Homo sapiens
cacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggttttgccttctcccaagaatcatggtgagcagctgatggagaatagctgaaaggtggaaagactttaccaaggaaggtctatataataggttaccacctaagaaatgaaacaactttctgaaagcccgggaaggagatgctctcctgagctcctcatgctccacaaggaggtcaaaatcaccaccctctttcagccactattttaagtttgaaataaacagcaagcttcctgccaccttgagtcttcctttgatgtgcactccctgcaagcaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaat

SEQ ID NO: 7892 - DNA, 2478 bp, Homo sapiens
ttattctgggattaaatgaaatataacacacaaaatgattggcatatagtaagtagtgtttaagtgttagtttctttatcctcatactcccaattcccaacaagtgggaagatgggtatacagaaatctaacccaaacaatgaaccaatttattttctttattcaatccttttcttctccttctgtcccttgttctgggcctccatgctttctgtgaaagatggtgtgatttacacaagacaaagccagtacctttccccattacttgtgcatagctcctggaactgcaccaaagagatggtagctgaggacctcaggcctctctctggacacggatactctcaagggtcatgacgaggatccctggatatttgggatcagatgatttaggatcacttgttcatggaggttggagaacatcagtgggctgttgctgtggcaatggagagcatgtcagatcaaaggtagcttgcgacatgtgcttgaggaaacagtattaacatgtgtgagggcaaccagtcaatttctgagttacacacaaatagcagaaatgaggaaagtcggaaaaattatgaaaagaagtgacaggcctgtttaggaaatacttagcctgtttctgatatgttgagtttcaggcggcagcagaacactcaagagatgccttggaatgtgagaatgcaaagccccaaacagagaacatccagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaat

SEQ ID NO: 7893 - DNA, 580 bp, Homo sapiens
aatttataaagaaaagaagtttatttggctcatggttcttcaggcggtacactcataactgcgaggatggcactaagccattcatgagaaatctgctcccataaccaaaacacctctcactaggcaccacctccaacaatgggaacaaaatttcaacattagatttgcaggggacgaatatccaaactatatcaggtggtcagaggtcactctggaacaaggggcagaggatgcacctgagcaggctctagaccttaagcactcttgcagctagcctagtggttggggtagaagcagccatttagaaaaaaatggccaagagatggggaggaggtggtcatagaagacagacttgaccaagggtcaagcctgtgttgagactgaaatgtaaaggtcatggcaagagaccaaatcttgatgatggttcttctttgacaagcaggacaatgttgaccagacctactcagaggagctgtgctataccctcatcaatcatcgggttctctgtacaaggccatcagggaactctgctgaagagtactatgagaatgttccctgcaaagctgagagacccagagag

SEQ ID NO: 7894 - DNA, 2181 bp, Homo sapiens
cacccttctcctttctgctgtctctgcacgggtggccagagccacacagccctttctttaagtcaggagttgccctgtcagagcacaaggcaagaaggaagtggtaaagggacggaggggaagccctgagaggactgagaggatgggaaattctctgctgagagaaaacaggcggcagcagaacactcaagagatgccttggaatgtgagaatgcaaagccccaaacagagaacatccaggaagacaaaggcattctaccatgagagatgtgtccaagttatctagaatgaaacacgcttgcggggagaaaaaaagttttccacagaaatggcaaaaggaaaggagtcaccttaacaaagctgcagaaatcaaccttatgatttgccatctctcttgggtattttagatgctgggatcaccatatcgctgaagggtgtttctgccttccatggaaaaaaatactcatttttgaaaagaggcaagattcccaaaacgaaaatgaaagaatgtcatctactcccatccaggacaatgttgaccagacctactcagaggagctgtgctataccctcatcaatcatcgggttctctgtacaaggccatcagggaactctgctgaagagtactatgagaatgttccctgcaaagctgagagacccagagagtccttgggaggaactgagactgagtattcacttctacatatgccttctacagaccccaggcatgcccgatccccagaagatgaatatgaacttctcatgcctcacagaatctcctctcactttctgcaacagccacgtccacttatggccccttctgagactcagttttcccatttatagtgaagtggctggactagcatttgtttagcaccaacaaataaaaggtgggatgggggatctgcctgaagcagggatgggacacaaagtccctccagcttatctcccacaacaaccctttccctgcagagcatggtttgtataccacaagccctcttagcacgcaaaagccaaaatctaaagatcaaccatttatcctgaacaacaccatttgagaaagaggtaaccatctttggttctacatggtttggagagtatagtggtaggaggggctccctgattcccctaaagctatgcacaccacaaggggctctgctcttctgtctgggatcttcttataaagtgttcccatgatcattctctaaagtcacaaggaagctttactcatcatactaagtgtgcccaagggggagttcactcattactgtgaccttccagctcagtccccacccatgggagcctgtgttgctcctctcactccatgtgtctaagtcatgtcttttacatagtgtcctttgacctgttggcccccatggtctggttagttatgtgagttgaatcaagaggctctaggccagatgtttacataattttaacctatatgattttatttttaactttgtatttctccctagaaatcttaataagacaattatgccatcagacaatgttaagaagaacgatccttggagatcccgtaatcccactacccttctttggctcagagaggataatttgcctaatgatacattaaagttagtggcaaaacttaatttggagcctgatttcctactgacttccaatttagtgctcccccagtatgctaaatagaaagccctctgcaatatattaaatgtatactaaatgtatatatttaataatgtcatgtataaaatatgaataaaatgtccacataggaaattaacacatatataccttctctgataagcactcctctatgtgtcctgattatttactttctcttatcttttccttagtgttcctcaaattatatctatcctctaaaccagggatcagcaaactataacccccaggccaaatctagcccactccctgtttttatagataaagatttgttggaacacagccacactcatttgtttacctactatctatgattgttcaaccatgggagagttgagtaattgtgacatggaccataggccctaaagagccaaaataaatatactttggcactttttggaaaaaaagtttgcagacacctgccctaaatgattatagtttgagagaaacttaacagaaatgtgtttggttactgatgcataagagcaagcaccaataaaatggcataaaaat

SEQ ID NO: 7895 - DNA, 136 bp, Homo sapiens
atacatcctctatctgaggacaatacattaaagggatttttggagcagggagatggaataaggactagtttcctccactccatgcatcaacctggtattgcagtacctccagaaatggtgcacccctcccaataag

SEQ ID NO: 7896 - DNA, 425 bp, Homo sapiens
tatggcaggaacaattcagaaacagcttaaatcattcagtcttcttcttcttcttttttttttttaacttgctgcattggtaacccttttcattcttgtgtaagaaattggaactgtagcacataatgatgctttggtatgaaataatggtaggaataaaaatgatttcttctgagaagcctgtgttaaagcacttggatactgataactggcttacagggaggctgatccaggtggtcttaaaactggctctcctgaacgccactcaagccccagtcccatctgctcctcctttgttaactcctgtcagttgatgcctctcctaggagtttctcccgctgcaggcacccccggggaacacccgagactacagatcagaaatggattccaatccagctggggtgctaactcacaataatcatctt

SEQ ID NO: 7897 - DNA, 420 bp, Homo sapiens
tcttctttcactgcctatataattaaaaaaccatctggttctaaaagtggcttcttgtatgtttaccagttgaaccagccagactttggctttggccttgccttttgtgtgcttgatggggaaatgaacaaagaagatacacataagaggtaaataaatgattctttgcatgaaacaatttcttttccccactgcctgctatactaaagaaaatcagaaagtgggtatccttttatcaaggtacagagcctcctgacattagaggcctcattctaagtgtctacacagataggtacgtacattcttctaggattggagccttcacttttatcagaatctcagatggacctctcttatccccaaacaaccatcattctgcagtcattatttaatgtattcagcaaaacttactaaaagacc

SEQ ID NO: 7898 - DNA, 117 bp, Homo sapiens
ggtaacctaccttggtacttgagttgagattttaggtcttgactttggaggtctggaacttgaccctaattcttacaaccttaattcaacttgacatttcaaccttgatttatattt

SEQ ID NO: 7899 - DNA, 810 bp, Homo sapiens
tctgaaatggaactgatctgtttctccagacctgcttctcacttggtagccccaatcctggtcatcatcaccgaagtcagaaaccctggaggccccttggactccccagtatcccctccccaccacatccagcctattaccaagtctgtgcctcctctaccctcacagctgctgccgccctagttcagtcctcatcttctccaggctgccttgctgggactgaggaaaaagagctcgatcccctgagcccttaggcagggcctggagtgagcagccctgggcttagacagttgtcattttctatttggcagtcccacggccaaagctgggaggtggaggcctctcggcacttgggctgatctctgtgcagttggagggttccctggatggacacctttctctgacattttacttacaacaccatcgtgcagtttccatagtccgtcagttctaacatgtgcttcttttctttcacattttaattgaatatctacagtaggaaggctcttacaatcaatgatgtgtcatggtgtaatttttttttctttctccctaatacataaaataagtggaagttttacaatcattggtgtcttaggatcagtgagatacagcatgattttccccgtgtctcaggcctgcttccctgagtcttccaatggcaggaacacgtggtggttctcctcagagctctggctcagcctccagaactgggactgagctaaagagtcactaaatggtcactgagattcaggagcagaacttccctgagagtggcttagctctgggaacctgacctgtccaaattaa

SEQ ID NO: 7900 - DNA, 487 bp, Homo sapiens
agtcaagccgtgtttttatggacaggtatgtgtgattagtatgaagttgtcttgtgcataatctatgcaacaaaatacacttagtatccaaacctaataatacaaaggtggatgcatatcccttttccatgctggatacttgctcttcttttcctacctcttctgaggagataatcacagaactttaagaaatagcctttgtagctgggtgcggtgcctcacaacctgtaatcccagagctttgggaggctgaggcaggtggatcacaaggtcaagagtttgaagaccagcctggccaacacggtgaaaccctgtgtctactaaaaatataaaaattagccgtgtgtggtggtgggtgcctgtaatcccagctactcgcgggctgaggcagagaattgcttgaacctgggaggtggaggttgcagtgagccgagatcgcggcactgcgctccagcctgggcgacggaacaagactccctctccaaaa

SEQ ID NO: 7901 - DNA, 498 bp, Homo sapiens
tttatttcaagttaatttttatatacatgtgagatagagatcaaggtttcatattcttgcatatgaatgtttgtttcagcaccatgtattgcaaagattatcatttttcaagtcagttatcttgggcactgttgtcaaaaatcaatcaaacaggccaaggtgggaggttggcttgagctcaggaatttgaggctgcagtgagctgtaatcacaccactgcactccccactgggtggtagcgcaagacgctgtctcaaaaaaattaaaaaaaatcaatcacacttatatgtttggccctatttctgtaccctattctgtgccagtaatctatacctatctctgtgtgccaataccacaccgtcttgatatactgcaactttatagtaagtcttgaaagcagataatgtaggttttccaactttttgttccttcccaaaattgttttgaccatttaaaatagtttctattttcagcttgttaatttctacaaaaaaaaaa

SEQ ID NO: 7902 - DNA, 336 bp, Homo sapiens
gatcattagacattccaaaatgtttgttaaataaatcccctaatgcttgatatgctgtttagttataaaagattgaagagctgtgagcccagctgtgattgcattgatcaggcagctgtattacattacagtgtctactccttcaagtatcagtttgctaaggaatctgactgtgctgacttgagaactccttctgcactattacctctggtgattaatgagaccaggcaccactggatgaatggatgacacccaatactccactattacctgtaatggaattaacttacaagtagcattgataaattctagttttaggcttactttccataggcc

SEQ ID NO: 7903 - DNA, 1528 bp, Homo sapiens
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcagtggctgatgcctgtaatcccagcactttgggaggccaagatgggtggatcacctgaggtcaggagttcgagaccagcctgaccaccatggagaaaccccgtctctactgaaaatacaaaattagccgggcattgtggtggtgcatgcctgtaaccccagctactcgggaagctgaggtaggagaatctctctttttttttttttttttttttttttggggcggagtttcactcttgttgcccaggctggaatgcagtggcacgatctcggctcacggcaacccccgcttcccgggttcaagcaattctcctgcctcagcctctcgagtggctgggattacaggcatccgccaccatgcccggctagtttttgtatttttaatagagacgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccgggaggcggaagttgtggtgagccgagatcgcgccactgcactccagcctgggcaacaagagtgaaactccgtctcaaaataaataaataataaaggaagaagtc

SEQ ID NO: 7904 - DNA, 923 bp, Homo sapiens
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcgggtgaggcggcgccgacctcccaccggccccggcccagcctctgtccagcccccgcccaggccctgtgaggcgggcgggcgagccccagcctccgccacccccattactgcctcagtccctgcgcagccggtcagcccccgggcctctgtgggtgggttggggccttcctcgccctcggccggtccaccactcaccagggtctgtcccagtagagcccgaaggcgggggcgcgggagggcttctggctggggcgaagagggcttgagggctcagtcgggatgctgtgatcgcacgcggtaaacctccagtagatcaagaagctgtacaaagtgcccgacttcccctcgaaacgcctgcccaactggaggaccagagggttggaacagcgccggcagggcttggaggcttacatccaggtatgcgagagcacagttggttgccccccggccttctgtgccaggggtgtggcccagacagagaggtgtgggggcatggcagggagggaacccacaacttggggatgttattcaccacctcaagcatcaattttctgagtctaatataggtccaaacacccccctctggcttgttgaaaggactgaaagaggtaacggacacaggtagtcccagctccatgaaacccaggtcctgtcccctccatggtgaggtcctgtgctgccctcctgatggcatgtagggtgaggg

SEQ ID NO: 7905 - DNA, 1340 bp, Homo sapiens
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactgggggtaaggggggccgatggcgggggccaggggctgtcagcagtgagcagcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcagtggcgcgatctcagctcactggagcccccatctcctgggttcaggcagttctcttgcctcagcctctcgagtggctgggattacaggcatccgccaccatgcccggctagtttttgtatttttaatagagacgggtttcaccacgttggccaggctggtcttgtactcctgacgtcaggtgatccacccgcctcggcttcccaaagtgctgggattacgggcgtgagccactgcacccggcctagatagtatatatttggataatgttttctaatctactctgccagttactgtgttttgattgatgtatgtagaccatttgtatttaatgtcattaccgacatgttagggcttaagtttgtctttctgtttttctggctctgtttctgtttctctgtttcctttttcctatttttctgtgtgttacttgaacatgtagaattccatttcgatttacctagtgtgggtgtgagtgtatgtatatttggtatagcttttttagtggttattctaagtattacattatatataattag

SEQ ID NO: 7906 - DNA, 624 bp, Homo sapiens
gagcgcgcggagcagctggggccggggcgcggatgctggaagttcacatcccgtcggtggggcccgaggccgaggggcccaggcagagcccggagaaaagccacatggtgagcgcggcccctggatggggaggggcgccgggacccgcaggatttccccgccggcgctcagtggggaccggggccccgggcctgggtgaacgagcgctgcgggctggaccgtcgggggaaaccttgtcgagggtttgggggccgcttggatttgccagctcgcggaccatggttcgagctcttgagggaccccagggctccgaggggcaggtccgccagccggttctcccaggtgtgcgggagcggagagtccccgggcagccgcggcgccgcaaggccgctttgtgcctttgagagcgggagggtgggcacgtcgccaggcgcaggtgctgcggcgtcctcccgcggggcctcacgcgcagacccgctgcccgcccgcgccgccaggtgttccgagtggaggtgctgtgcagcgggcgcagacacacggtgccaaggcgctacagcgagttccacgcgctgcacaagcgggtgaggcggcgccgacctcccaccggccccggcccagcctctg

SEQ ID NO: 7907 - DNA, 1206 bp, Homo sapiens
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcgggtgaggcggcgccgacctcccaccggccccggcccagcctctgtccagcccccgcccaggccctgtgaggcgggcgggcgagccccagcctccgccacccccattactgcctcagtccctgcgcagccggtcagcccccgggcctctgtgggtgggttggggccttcctcgccctcggccggtccaccactcaccagggtctgtcccagtagagcccgaaggcgggggcgcgggagggcttctggctggggcgaagagggcttgagggctcagtcgggatgctgtgatcgcacgcggtaaacctccagtagatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccagg

SEQ ID NO: 7908 - DNA, 1293 bp, Homo sapiens
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcagtggcgcgatctcagctcactggagcccccatctcctgggttcaggcagttctcttgcctcagcctctcgagtggctgggattacaggcatccgccaccatgcccggctagtttttgtatttttaatagagacgggtttcaccacgttggccaggctggtcttgtactcctgacgtcaggtgatccacccgcctcggcttcccaaagtgctgggattacgggcgtgagccactgcacccggcctagatagtatatatttggataatgttttctaatctactctgccagttactgtgttttgattgatgtatgtagaccatttgtatttaatgtcattaccgacatgttagggcttaagtttgtctttctgtttttctggctctgtttctgtttctctgtttcctttttcctatttttctgtgtgttacttgaacatgtagaattccatttcgatttacctagtgtgggtgtgagtgtatgtatatttggtatagcttttttagtggttattctaagtattacattatatataattag

SEQ ID NO: 7909 - DNA, 491 bp, Homo sapiens
gtgatttgcagtcagctttcaatgagactgggaagatcttgagaattagctgtcttgacatttggaacacattccattgcattaaaccaaagaagcctttaaaactgaaccatgcatgctgcttttcactatttttgttcactggctacggttcattcccaccatactcttctcttaggtaccattgccccacgtaagcaggtaatgccttggtttgcccagctcttggtagaattttgaactgacagcggattacattgtgtcatgaggtgggaagggctgggaaggcaacatccacatatccccattatgatctagtcattgtttccatttcaaaggagcgatatattcagctcagcacttccgtctatttaagatatgttagctccatgaatcagagtgaatctacatattcccattgtgaacctgacattgaaatatacgttttccagtttcaatctactcacctgttatgagtgaagcttaccttt

SEQ ID NO: 7910 - DNA, 521 bp, Homo sapiens
gcaacaggataagaggaggaagaagagtgaatgttcctcttatacctcactaaaccactttgtgagctgagccatacatggtttctggcaatagatttgggaatgcaggcctggctggaggcgagcccagcgtgacatccaccccttgctagggctcagtgttgaacttaagtgaaacatcaacctgcccagtgctgcccacctcttccagaacccctttcctctccgttcacagggcaggctttcccctcaggtaggaccaactgggggttactgcttttgctgcactgaaattttttgaaatttggaattaagtctctgtccttcccccagtcaccacaatacagggtacacattctgactcctgtctagctttgatagtgttatccattcaaacagcaaaagaacaagcacttgtcaccactcaacactgatttagaatttatctgcttgctttttttgttttttgagacttagtctcgctctgtcccccagcgtggagtgcagtggcgtgatctcag

SEQ ID NO: 7911 - DNA, 542 bp, Homo sapiens
gcaaattagaaaactagagagaaaggaagtggttccagtctaccatgagcagctcataggctagatgaactgaacatagcttttggtttgttctaaggaaaggatataagaccaaagtgtccataaagttcttatttaaagtaacttttagagtttggggtaagagatctttcaattgaaactactaagaatacttcttaggccaggcaatttgaattgatgagataagataaagctgaaggtcaaagttatgactttgagaagagtcaaggcaatgccatcatcaagggagccaatcttccagtagacaggggctcctggagtgagaactacagacctgctgtttccaggctgcaaattaattgcattggcccagcagacaccatcagtaaacaagcctgccagggaatatctacttgatcctctttcacagagcaaacttccaagggctgcctgggtcccatccttattttgttatcatcttcaagtgagtccaagtgcacagcaatgaaaaaaaatgcatgtgtagactaaaaaaaaga

SEQ ID NO: 7912 - DNA, 605 bp, Homo sapiens
aaaatataagcccaaaaaattggataaaatgcactgcaaaaaatgaggcaaattattggtaaccaatttatttttctctccctccctaactccctccctccatccatcctttcctcccttcctcccttgtttccttccatccattctccttccttgttttcctccttccttccttgcttttctctctctttctttcctttttgggtacataatcagaatactttttccacaaaatcatttgaaataatttttctctatttgttcatgccaacatttatacagctagtttaattgttcagttctcttttttacattttggaattttgttgtattactttgttttgtttcatatctgttttgtatatataaaacatttatatgaaactaaagtcaaaattataaaagatgatgcatttgaagattttagctttcattttagatttcttattcctcttttctccctgacactataggtaacaatatttttggcagttcacttgagctttttcactgtttgtcatagcggagtatgtattgtttctattttaatgccatatttatattttcgttctgatatttggtttttatacattttaatcaatctt

SEQ ID NO: 7913 - DNA, 144 bp, Homo sapiens
cttccctctcccctttctacctctaattacaatcctgctgctccaaatctctgatgatggcatcttcccagaccagcttttatctccccttccctccccaggatgattactgccagtcatttccaataaagcattcctggggac

SEQ ID NO: 7914 - DNA, 1449 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttg

SEQ ID NO: 7915 - DNA, 1268 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaactgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttg

SEQ ID NO: 7916 - DNA, 1676 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgatcagatgcaggatgcttggtgggatagcaggggctgaccggagtgttgctgggaaagagcctcagggtcggcctcaggtctccacaaggtaggactgggaaacctgtgggcctggaggagcagtcctgcaggtcagttcacggcggttttaaaggaaaactccgaattggtagagtgatgtacgacagacaagaggtggggactcagagagcaagaaaagattagttcgagtgtaacaagagacagggaaaatataaaggggagacagaggcaggaaaaaata

SEQ ID NO: 7917 - DNA, 1420 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggtgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttg

SEQ ID NO: 7918 - DNA, 1542 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggaggctccccacgcttggcctaccgaccaacgggaccccggccccacggcgggaagggaagggaaggggatcacttggcccatatccttccaggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttg

SEQ ID NO: 7919 - DNA, 1392 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttg

SEQ ID NO: 7920 - DNA, 1379 bp, Homo sapiens
tgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaactgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgaaaaaaaaaaaggccggggtcttatttgggcgtgcggggaacgcggttttgaatggcccatgtctaagttttcctgccccctttttgtcagggggaaatctgcggccctag

SEQ ID NO: 7921 - DNA, 342 bp, Homo sapiens
tctggtgctggtgtgaaactgaagagctccgcatcttgcttgggttggtgggctcggcccgcactgcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgtgaacttgtgtgttttcctgcttctagcctgctggcatgtgcagagctcagctatgcttcagaggccacccagcctccagctccatgtcccta

SEQ ID NO: 7922 - DNA, 1720 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7923 - DNA, 1489 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7924 - DNA, 1584 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7925 - DNA, 1618 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagaaatggacttcagctgatcttcatattcatatggagtttccagtgaccccaaatagccaaaacagtcttggaaagaaaaacaaagttggaggacccacacttcctgattttgaaacttgctacaaagctatagtactcaacaaagattggtaatggcataaggatatagattaagaacagttttttcaacaaatagtgttgggacaatgggtgtccacatgcaaaagaataaagttgtccccttaccttacaccatctccaaaaattaactcaaaatatgtcaaagacataaacgtaagagctaaaactgtaaaactcctagaataaaacataggagtaaatcttcatgaccttggattaggccattgtgtcttaaatataacaccaaaagaataagtaataaaaaaatagataaattgaactccatcaaaattaaaagcctttgtgcttcataggacaccatcaag

SEQ ID NO: 7926 - DNA, 1674 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtcagggaaacgcacaggctttcctctaagcgggaaccctggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7927 - DNA, 1761 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtcagggaaacgcacaggctttcctctaagcgggaaccctggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7928 - DNA, 1555 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7929 - DNA, 1453 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagaaatggacttcagctgatcttcatattcatatggagtttccagtgaccccaaatagccaaaacagtcttggaaagaaaaacaaagttggaggacccacacttcctgattttgaaacttgctacaaagctatagtactcaacaaagattggtaatggcataaggatatagattaagaacagttttttcaacaaatagtgttgggacaatgggtgtccacatgcaaaagaataaagttgtccccttaccttacaccatctccaaaaattaactcaaaatatgtcaaagacataaacgtaagagctaaaactgtaaaactcctagaataaaacataggagtaaatcttcatgaccttggattaggccattgtgtcttaaatataacaccaaaagaataagtaataaaaaaatagataaattgaactccatcaaaattaaaagcctttgtgcttcataggacaccatcaag

SEQ ID NO: 7930 - DNA, 841 bp, Homo sapiens
agtttcccggaagggtagcgattaccggagcgcctcgcgcgcctgcccgcctgcggaggacccgggcgcacacgccttagcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 7931 - DNA, 328 bp, Homo sapiens
gcctcttcccactcgtccctgccctgttccctcccccgagggacctgctgcatgtaccccccaacctcccatccaccaccaagtcctgctagcgttatttccaaaatgtaacccacctccagctgcctctcctgtccctgctgctgccatcctgcccagagccaccgttagttctcctggactccagttctgctcctgacaggcacctgggctccaccctggacacagaggccagagggatcccttagaagtgcaagtcaggtcagacgtgtttcctgagcgagcagctgccagcagagaagagaccacatcctactccaaggagagg

SEQ ID NO: 7932 - DNA, 321 bp, Homo sapiens
acgttaacacagttactaggcttgaaaaaggctatcttgctataaacattctttcctcaagattttagacgttttgttcataggtcaggaaatttagccctaagatatttcaagaggttaatcttagagaataagtcttctcaagatcattgagaagattataagaggttatatgtgtgaaaagttagtggaaagtactacgtgtaaaacaccattgttttcattttttaattggcaaaggcatgattagtggcaaaaacagggtctgtaaactgtatttcatttcttttactataatatcataaacattgtcttccattt

SEQ ID NO: 7933 - DNA, 503 bp, Homo sapiens
gcctccagttctgtgagggtcagaagctgatccacagtaatggctgccaagcagtgcttaccttgagagagggaatagcaggaaagccacacgacgagccttctaggatactggggatattctctctatagatctggatgtgtatatgatgtgtacattcaccaaggtgtacacatgagatatgtacacttctctgtattccattacaccttggtttttgaaaagacagaaacagcatgctcagcttattaagaacctgaatattttcagacaaaaagtatgtctagtgttagtccacttttttttttttttagttttagactcacagagccctcttagggtcatatttagttgtatatcatctgacaaaagagggaatggctcacccagctgctacagtcagtcttgtagcctttgtaagatttgatgataaatcatacaataaattaaaactttcggctgggcacagtggctcacgcccataatcccagcactttgggagg

SEQ ID NO: 7934 - DNA, 500 bp, Homo sapiens
tgtttgaattcatggtggctttacttcattcacctgtatggttggggacaattccattctaaatacatttattcagcacctgccatatatcaggcactctgttaggttgaaagtgttggctcattggagaagacagagttatttttacattacatttccagagtatatcacagtgtttggtacatagaaagcacttagtcaacaatgaacgtataagggagctaaatcactaaatggttttaagaagagaaaataaatgcttactatgtgatgcagaatatggttagtgttatatttgatataggaacctaccagggctaaaaaaaaatttagagattatgtaagtccgaaatattggtgaaaatttcatggaggatgtgcgatttgatatgaattttaaataatttatagaattacatgtaaatgtctaaaggaatggtatggccaaaggtctggagttggaaatatatgtgcctgaaagaaatatagcatagtgatta

SEQ ID NO: 7935 - DNA, 349 bp, Homo sapiens
ttttagggtcttgctttgttgcccaggctgaactcaaactcctagctcaagtgatcctcttgcctcagcctcctgtgtagctgagaagggaggattgcttgagtccaagagttggaggctgcagtgatcaatgatcatgccactgcactcctgttgcctgggcaacagagtgagatcctgtcccttcaaaaaaggagcaaaatacatattttccttagcacaaaatatttgcaatttgtttataaaaccaagttttctaaacataattctgtaacaaaatataaagtccatttaagttggatcatggaccccaccccaccaaatctatatttttcaaagactaagactg

SEQ ID NO: 7936 - DNA, 523 bp, Homo sapiens
agagtgaatgggagcaagatggactaaacttcagagaatattattttagctcacagtgcagatctatatcacctatactttagatatcttttaattaaatttttatagattaaaaatcaaatattactgaaatattgatatatgtatgcatatcaggttttttagggtaataaatttgctcaacttggacttaagtttttgtgaagaattcttataagtgttgatttctctctaattagctatgtggaacaaacgtaatttcctaaaaagaagtaagctagtaataactttgattttatatttctccttaaatgacaaaccaattttactaccagaactcatttcaaaagtatttctgggctatttgtatgactagctcattttgtgaaataataaaatacataaaaatagtaaggctcagtaacttgtccaaataaggtatttttgaggatagtacacatgcaaattattacttcatatcacattttaaaagggcttataggtttgaaagttttcatatagt

SEQ ID NO: 7937 - DNA, 633 bp, Homo sapiens
ctgaaatcctatatattgttaactaaaattagaaatcatttgtatttcttttgacttgcagcttgttagaggcttcttagtcattagctagaaatgtattttttctcttcatgtattttcaaagaaggatttatgtaaccatgttgtcatttgggaggcactgagtgttaaatatcataggatgccagaagcccacaagaagataagaacactccagtgaggacctctgaagagaaacagcaaaagcatctccatcctgcactgagttgtgggttattattgtcatggaggtgaataaaggatgatttaggagatggtactataatgtggaggaaacatccagcccatttatggttcaggaaaaaggtttactcctttgagcttggttgggttaaaacattgtattgcctactctcataatgctggaagtataaagagatcaataaagtttcctcagattctgtaagtcagacttgtctctattttcttaacatttccagggaagtcaagatcacaaaaagtggttgattctggtggtgggaatattgatattgattctataatattactgtaaattctttctccgagattaaatatattgtgcacaagtactctgaccacatctctagattc

SEQ ID NO: 7938 - DNA, 104 bp, Homo sapiens
ttttttttctttgagagggggtcttactctgtctcaacctccttggctcaagtgattctccctcttcagcctcctgagtgagtagctgggaccaaagggcacac

SEQ ID NO: 7939 - DNA, 419 bp, Homo sapiens
atttttaaaaagtgctcaaagcatctatttttcatagctgtgcaaaagtaaaagaaataatattcatttttcacttcatgcaagaacctcacttgcatgaggttctcgaaatagaaaatcataatcaggacaacttgtcacttcttcagatgttttatatagaatatcatttggcttctaaatctgtgattccttttttgtctgtggctccagattttcataatctaccactattaagcagaagtggtaatttatgaagaaatttgggtttgaaatgcttattattttcatgaagataaaaagtaaaataagaatgttaaccatttgagtcctgttgctgaagggcattgagaggagttgagccccatctctctctcccattgcagtagttcctcttaaagtctcccttaccatcttaa

SEQ ID NO: 7940 - DNA, 330 bp, Homo sapiens
gagttactgcaaggtttaggcgagacaatagcaaaaatgttttcgggggctgcacaaaaaagagggaattgtagtagttttacatcgccataacaagcagaactggtacctgctggtggatggtctgtgcttcccagagcgggatctgtggatgcttggggagggggaccactgagatctttcagagggtacataatgttcaaactattttcatgttattgagatgttttgtctttcaacatttgtacttaacggtgcaaaagcagtggtggaaaatgctgtatccatcataggaacaatcaaggcagagaaccggtattgtatatagtc

SEQ ID NO: 7941 - DNA, 585 bp, Homo sapiens
acgtgacagcgtcgaccttgagtgccagcaatcaagaggaataaaagatggcgcagcagaagctggccaggcagctggatgattctggaacttggaaggcataatgagtgaggttttggatagagtctagcggcgtccctggttcaagcactgattggtccccaaccatgtccacatccttgtgaaactgtggggcagggcaaggcaagccagctcaggctctgccccagtaggagaggcaggcaaagagacagagatacaaaacaacgtgtggttaagcatttggaggctggaaatgagttctcctgggcaggatgagggcagatacctgcggtttctgggctaagacgaacctacaggtagctgcaaatctgagatgtgcccaggtgttccatgctgacggcctccttgtctcctgcagaatccaggtgggcattttttacctgctcccaatgcaaggtctgtctatgagcatctgtcaattcctttaaagtcctacaattgaaagatgaagagccgggctgtgcagtgtgtggtctggagggagcctggcaccgtcgactccagctgcagggtgaggtgtag

SEQ ID NO: 7942 - DNA, 242 bp, Homo sapiens
tccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagac

SEQ ID NO: 7943 - DNA, 324 bp, Homo sapiens
gacaaaacactcttcagctttggggtaatcatttttggtttggtaaaaagagtgactgaaacttgcctaaagattaatttttagaggactctgaggaaaccagattggcagtgaatatacagtgatgaagtgagaaacacttcagcaaagggtggaacaaattagtaactgacttactacacatcctggcaaaaacagcaacttagctaagagtctaaactctcctttcaaatctagaatatcttggtgggaaggtgggagatgagcagcttataaatagcaaaatcaactgggattttgagtttacttgtccctgttataccc

SEQ ID NO: 7944 - DNA, 280 bp, Homo sapiens
aagtcattccatgctgaagacatccctagggcaggtagcagaatacctaattcaacctagagaggcacaggctgcacgagagtctctcagataaagccccattgaaaataaattgacaatctaaaatttaaaaacccgttaaaaaagcagcacagcatgaggagtcagtagatacactgaaagcaagattagatcttcaagactttcaaactataaaatttagaaaattataataaattatgaaatagaggccctttcatgtcaaaaagtcatgaaagaa

SEQ ID NO: 7945 - DNA, 494 bp, Homo sapiens
cccaggcaggagtgtggtggtgcagcaccttgctcactgcaacctccgcctcctgggttcaagagattctcctgcctcagcctcccaagtagctgggattaccacaaccagctaatttttgtattttttcgtagagatagggtttcaccatgttggccaggctggtcttgaactcctgacctcaagtgatccacccacctcagcctccaaaagtgtggggaattacaggcgtgagccactgcacctggccctcaggcttaattgttagaaaaatatccaaagcaaatacatggaaaaaagcatatctccttgacatttgttcttagacaagctgtgggcagtgtttctggcaaagccatttacattctggataatgatgccaacaatggaactcctggacaaggaggggggagacagagaaagaacgggccagaaattcggaaaaggaatgttctcaggactgtgttgagttggccctggcatgttctccttcc

SEQ ID NO: 7946 - DNA, 545 bp, Homo sapiens
aagttgcaggatgttatatttacaggctgaggttatttaaataaactaaaacaaacaactaccaattctccatggtaacaagtataggaaaactgtactgaaccaacatataccaaatttgcaaaagtaattgtttcagttagggcacagggccagggtcatgataggaaaagggaacagaagaggaaacagtggttaaaaatgactttatctggccaggcacggtggctcatgcatgtaatcccagcactttgggaggccaagtgtggggaattacaggcgtgagccactgcacctggccctcaggcttaattgttagaaaaatatccaaagcaaatacatggaaaaaagcatatctccttgacatttgttcttagacaagctgtgggcagtgtttctggcaaagccatttacattctggataatgatgccaacaatggaactcctggacaaggaggggggagacagagaaagaacgggccagaaattcggaaaaggaatgttctcaggactgtgttgagttggccctggcatgttctccttcc

SEQ ID NO: 7947 - DNA, 1922 bp, Homo sapiens
ccagtcagggacagccagacttgtaaactgcacctgcttccacagtcttagtgccccgtctaaaaggaacaggcgctgaagcactcatcttgccgattttatttcaaacgtccaggagatggcagcaaactctccttccctctcagtgcttcacaggcagccattctaatgctcgttgcattacaatttgctttgaatattctttttttaaaaaagacaaaagactaaagggggtcttgagacgtgatttttatctgaccccctgcttctaatcaagaatgagtataaatatttctagggatagaatagaatgatacaattttattatctagaaaagagattggatttccttggctattttttcttatctctggggaaaaagattgtatgacttcccttggctgttgggccctagactctgttatctccaaatccaaaatattcttactaataactagcttaaatctatctggcagtaatctaaacattcttattttgggatctaggctaatggaaaattttgaagcactttgaatgcttattagctttttaaaatgaaaataaatacgattataaaattttcaaaagaaaaaggaagttcatgcactttgtgcatcatagggaaagagcccaatatttttgtttaactttaacattaatcttggcaaatagagtagtatgtcaacaaaatgcaaaatcagtcagaggctgcttatatgttacaagagtgtacggaacaaagaaacaggcagacccacttggtgacggctttgatcctaacaagcacattgttttcaaaactttgaggcactaaagtttatttctaaaacagaaaagatggtgacgtgttggaagttctgtgatgtgaaatatatgtttgtacatttaccagtgggaggagaaaagactaatgggagagctggatattataaatgatgggttaatgctggagcctaggtcactgcacaggtttgatgccatgtggtcaatgaatgactgatctgttcattgtattttgtttgtttggttggttgttttttttcttttgtttttgttttgttttgttttgtttttagacagagtctcgctctgtcgcccaggctagagtgcagtggcaccatctcggcttactgccatgtttttttttgttttgttttttgtttttgttttggataattgcttaagaatttagacacacatactactaaaggatctctcttttcctctctttctctcaaatgtgtattgatgagggcctatccattttagtctccccagaagttactttttatcttaggctaagattacatatccatagcagttaagagggctgatgtagtattttagctaattcataatgtttttgtaaattcatcaatgcatttgcatgaattaatactaaaagtgaaaaaattgtttaacaattgtaatagtcaataaatacctaacatcaaatcaaaatgaaggcaaactttgggatggggagaagtcaggagaatactaaagaatgagatccttttaataaatgtgtggtctacatggcaaaatttgctgtagtattaacatacaatgttatctcaagacaattatacattgcagcttcatgaatgcattaagaaagctatgctggccaggcgcagtggctcaagcctgtaatcccagcactttgggaagctgaggtgggtggatcacttgaggtcaggagtttaagaccagcctggtcgacatggtgaaaccccacctctattaaaaacacaaaaattagctgggcgtggtggcacatgcctgtaatcccaggtacccggcagggtgaggcaggagaattacttgaacctggggagcagaggttgcagtgagcccatatcgtactgctgcagtccagcctgggtgacagagacagactccgtctcaaaaaaaaaaaa

SEQ ID NO: 7948 - DNA, 414 bp, Homo sapiens
tctcatttctttcctgctctggcaagtcttcctgacctctgtggtcaccaagctggaggcattttaagctaagtgggtcacacttagtgggctctgtgcaaggcctcaccatctgactgtcagattctcttgcaggttggacaaagctggagaagccaagaggaccctaccagccccagcccccatcctgccaaggcattctccatgtgtggagccgagcgctcacacttgggtgtttattttcacacatagtcacatagtggtcacactagcgtgcttgttttcacactgctgtccttctgtggaaagccctgtctgactttttaggttgtggattccaccctttccacccaactgagtgttaaatagtttttgagtgagcattcagagtgcttggaagttactataattagc

SEQ ID NO: 7949 - DNA, 454 bp, Homo sapiens
cttccagctgctaatgtctgtctaactatctaacaagtctgttttggggatttacaaaacatttgaattatactgtaatcatatttactagggaaaataagttaccataaaccattttatttgaaactttctcaggaaactaaaataactaaatatcatcagttttagttactttagcatcgtgagtgatgaggaggcatgtcagcttgtagagacaatttcaatctggagtcctacagatctggattttaatcttcctctaccgcttactatccatttcgaattaatcaagtttcaattttctaatatacaaattgagataagaatatttactaccatccgagagtggttgctcacacctgtaaccccagcattttgggaagccaaggcgggcagattgcttgagctcaggagttcaaaaccggcctgggtaacttggcaaagcactgtcttt

SEQ ID NO: 7950 - DNA, 419 bp, Homo sapiens
tgagacaaggtcttactttgtcacccaggctggagtgcagtggcatgatctcggctcactgcagccttgacctcctgggctcagccccccaagtagctgggactacagccacgtgccaccatgtttggctaattatttgtattttttgtagagatggggttttgccatgttgtccaggctggtcttgaactcctgagcgtagttttttggtggacacaggtggattgcttgagcgatctgcctgccctgaccttccaaagtactaggattacaggtgtcagctaccacacctggcttcatgtcttgctttcttttttgcttttcagttccttgctccatttctctctttcctctcatattttactgtaagtaacaaggagaaaccaggatgtctcttccgcactttgcttggaaatctc

SEQ ID NO: 7951 - DNA, 450 bp, Homo sapiens
gatgaggtttgaggatgaacctaacagtgaatgaaaatttattaggtttaaggaaaggatgtgcaaactgattgcagcttccctgcaatcctttacgggacatcagaattcagtttatgaaagttctatgaagtctagagttttgataatggtatttcaatggtgtaatgttcaattacctgcatgaaggcaagagaatgaaaaatattggttcattcataaatgtctaactatatttagtatggctctaaagtatgttttttaaaaaaaattaacagtgacttaaaagagtattaaaaaaaaaacaacacacatatgggccaggtgcagtggctcacacctgtaatcccagcactttgggagaccgaggcaggcagatcatttgaggtcaggagttcaagaccagcctggccaacatggtgaaaccctgtctctaccaaaaatacaaaa

SEQ ID NO: 7952 - DNA, 325 bp, Homo sapiens
cattttaaaacattttgcctaggtccaggtggagttcaagtattttgaaaagggagcttaatagaaaaaaaaattgtgctgagagaggttgaaggtatctttttctaaacctctttgaatataggttagattcgtatctggctcatgaagtttcagagtgatgtgttttaacttgaaggtaaaagataaagagatccccaaaggccattctatagactggcagaaaaatcgcctggggaagttgttataaaaaaaaattcctgcaccctacactaaaagaacctgattcaatcggtcttaggtggagcttaggaatcagtgtttt

SEQ ID NO: 7953 - DNA, 216 bp, Homo sapiens
ctctggcctgggttgagggtgagggaaatcaattcctgtgaacatctccaaaatgctacccatataatggtgccacctggactgggattcagttgtggccacgcaactgagcggatgctacaaaaataaatacatacatacatacatacgtacatacatacatacatacagaaatgcctgccctaagagcaaaaatacagaggaaggcctacacac

SEQ ID NO: 7954 - DNA, 417 bp, Homo sapiens
atccaatataaatcattactctgtttttataagtaacaagagagggaggagctattactgatttaacacttgtagcccatatttatttcatttgatttggaacctttctcttttttcaatgctttgctattttaaaatgtgcccattttcaccatttactgtggctcctaaacgggtaaagaagaaaatttaaactaaacaaataactaatcctgctttagaaatcaagatctgctagggaagaaaaactccctaatccgtacagaggatcatctctattacaaaagtccattagcagaatggtacatgttccctctttatttccacccaccactcctgcctaacaaatataataagaaacagaaaacaggacacatttctatttctataaagagaaaataccgggtcccgaaagct

SEQ ID NO: 7955 - DNA, 429 bp, Homo sapiens
aaactggcctcccacaaaggtttccggggtagagatgttgaagaaacccacaccccaataatggttgcccaaattgtgagtcctaaaataattaaatttgccctggctccctatttgatctgttgggttttgtgtaaatactttacatttcctaggtttctttttttaacctgacttacaactacatctgtaaagtagctccctagtgtcatcaaagtaggaaccacatcagaagaaaataaattgttggtgagtgactgtatgttaaaaattaaaaataaattagattggctgggcgtggtggctcatgcctgtaatcccagcactttgggaggccaaggcaggcagatcgctttgagctcaggagtttgagaccagcctgggaatcatggcaagaccctatctgtataaaaaatacaaaaaaaaaaa

SEQ ID NO: 7956 - DNA, 355 bp, Homo sapiens
ggggtctcaaactaaaaattcatccgaagtagtcccaagtttcagatgaatttgtattctttatatagtaacaacatgtgcttgatggcaggactgtattccataaattatgatgtcagttgttgctatgctcatcagtattgagctatctagcaatattggggtgggggttagaatgtgaggactatgtgaaagcagtaagacaggacttggcatgtgctacgctgggatttgctgagctgtgggggctttgtggttcacaagtccaaagggtgaatgatttcaacaacaagaaggccactatataccagctcagtattctccctggagtgtcttattctatttacaaaactgc

SEQ ID NO: 7957 - DNA, 1503 bp, Homo sapiens
agaaggagttgagtgatggtagatatcaggccctggtctgcggttggaagtttcctgtgaataagaaaaacatcatcgcttcttgagtcacaaggatgataggatgagaaaaagaaaggacaaaggcaccagaggaggtatgccaaatgggaaacttttcatcactttccagataaaaactagcagtctgtgaaggcaactggtctgatttttcaggtaagaacatatgagaggcaggctgagaccaattttctaccaggccagctaattcatcacaatgacaagctatgggtcatatgctttcaggaaccagacactggaacatgtcgtctgatgtacatcacaccaagaaataaaaaaagaattggaaagccaatgtccaattatttactaaaacagaatccactggagagaaatgcaaaggcaggtaaaaaggcaatctcttaacatgaaaactcacaactgtaaaatgagaacctaaactatacagcgacaaactcaggaaaaagtctccagctactgctgtctctcagactctcacagtatgtgtaaccacttcctcctctgcacggaatcaccccagaagatcaactctactagatcatttgaggacaatgaacaaagtctcaagactgaattcccacagaaaacattctcatgaaaccacccaatattctggtgaagttaaagaagggcatgtgttcggagacaaccagaagcagcaatgctcaaaaccacaaaactctggattgccgactctgcacatcctggttcctctagatacagttcagtggcacattcacaaataaacgttttcaaaaactgccctcaggcagttctagagaaatgctttgacttgcctaatggtataatgtcaagaaaggaagaccagcactgatcattcatactcattattacagtcacagggcactgtctgacttgacagatacagccgagcagttaaaaaggttatgggaatttaagtccattatggtcatacgattcttatggacccagagatatgaaattaatcagccacatgtgtagggacaaagtttgtcataaatagatataagttatctgcatgctaagaacttagttacttaactctgtttcctcatgttaatataaacataattatagaatgcaaatgaaatacttagcctggagcctattatataggaagcactcaataatttcaaactattgagtatattattagataggctccataattatttattcctttttcaacagacagtatgatctattgaaaataaagccaaactagatttctttgacccactcctttttctgtttgtattgttggcaagttgttctaaatcaacttgccaacatactattaacatgttattaacatagaagggatgcttattttgtttgctttgtaagaaatgcttctgattcagtaactgggcaatttatttaaatataagtaaaaagcagattttattaaaaactactttgtgctatcataaataa

SEQ ID NO: 7958 - DNA, 1413 bp, Homo sapiens
agaaggagttgagtgatggtagatatcaggccctggtctgcggttggaagtttcctgtgaataagaaaaacatcatcgcttcttgagtcacaaggatgataggatgagaaaaagaaaggacaaaggcaccagaggaggtatgccaaatgggaaacttttcatcactttccagataaaaactagcagtctgtgaaggcaactggtctgatttttcaggaaccagacactggaacatgtcgtctgatgtacatcacaccaagaaataaaaaaagaattggaaagccaatgtccaattatttactaaaacagaatccactggagagaaatgcaaaggcaggtaaaaaggcaatctcttaacatgaaaactcacaactgtaaaatgagaacctaaactatacagcgacaaactcaggaaaaagtctccagctactgctgtctctcagactctcacagtatgtgtaaccacttcctcctctgcacggaatcaccccagaagatcaactctactagatcatttgaggacaatgaacaaagtctcaagactgaattcccacagaaaacattctcatgaaaccacccaatattctggtgaagttaaagaagggcatgtgttcggagacaaccagaagcagcaatgctcaaaaccacaaaactctggattgccgactctgcacatcctggttcctctagatacagttcagtggcacattcacaaataaacgttttcaaaaactgccctcaggcagttctagagaaatgctttgacttgcctaatggtataatgtcaagaaaggaagaccagcactgatcattcatactcattattacagtcacagggcactgtctgacttgacagatacagccgagcagttaaaaaggttatgggaatttaagtccattatggtcatacgattcttatggacccagagatatgaaattaatcagccacatgtgtagggacaaagtttgtcataaatagatataagttatctgcatgctaagaacttagttacttaactctgtttcctcatgttaatataaacataattatagaatgcaaatgaaatacttagcctggagcctattatataggaagcactcaataatttcaaactattgagtatattattagataggctccataattatttattcctttttcaacagacagtatgatctattgaaaataaagccaaactagatttctttgacccactcctttttctgtttgtattgttggcaagttgttctaaatcaacttgccaacatactattaacatgttattaacatagaagggatgcttattttgtttgctttgtaagaaatgcttctgattcagtaactgggcaatttatttaaatataagtaaaaagcagattttattaaaaactactttgtgctatcataaataa

SEQ ID NO: 7959 - DNA, 1424 bp, Homo sapiens
agaaggagttgagtgatggtagatatcaggccctggtctgcggttggaagtttcctgtgaataagaaaaacatcatcgcttcttgagtcacaaggatgataggatgagaaaaagaaaggacaaaggcaccagaggaggtaagaacatatgagaggcaggctgagaccaattttctaccaggccagctaattcatcacaatgacaagctatgggtcatatgctttcaggaaccagacactggaacatgtcgtctgatgtacatcacaccaagaaataaaaaaagaattggaaagccaatgtccaattatttactaaaacagaatccactggagagaaatgcaaaggcaggtaaaaaggcaatctcttaacatgaaaactcacaactgtaaaatgagaacctaaactatacagcgacaaactcaggaaaaagtctccagctactgctgtctctcagactctcacagtatgtgtaaccacttcctcctctgcacggaatcaccccagaagatcaactctactagatcatttgaggacaatgaacaaagtctcaagactgaattcccacagaaaacattctcatgaaaccacccaatattctggtgaagttaaagaagggcatgtgttcggagacaaccagaagcagcaatgctcaaaaccacaaaactctggattgccgactctgcacatcctggttcctctagatacagttcagtggcacattcacaaataaacgttttcaaaaactgccctcaggcagttctagagaaatgctttgacttgcctaatggtataatgtcaagaaaggaagaccagcactgatcattcatactcattattacagtcacagggcactgtctgacttgacagatacagccgagcagttaaaaaggttatgggaatttaagtccattatggtcatacgattcttatggacccagagatatgaaattaatcagccacatgtgtagggacaaagtttgtcataaatagatataagttatctgcatgctaagaacttagttacttaactctgtttcctcatgttaatataaacataattatagaatgcaaatgaaatacttagcctggagcctattatataggaagcactcaataatttcaaactattgagtatattattagataggctccataattatttattcctttttcaacagacagtatgatctattgaaaataaagccaaactagatttctttgacccactcctttttctgtttgtattgttggcaagttgttctaaatcaacttgccaacatactattaacatgttattaacatagaagggatgcttattttgtttgctttgtaagaaatgcttctgattcagtaactgggcaatttatttaaatataagtaaaaagcagattttattaaaaactactttgtgctatcataaataa

SEQ ID NO: 7960 - DNA, 294 bp, Homo sapiens
ctttttcggaaaatgaatgattattcaaaaagctctaaactatgtccctgtatagtcagacatatatatttatcaacaaaacaatgtccctgtagcaccagatatacatatctggtcatttaaatatatatctatatagagaaatagatacatttacatatcaaataacaagtaaaaaaaaaagaaaaactaacataaattaaggcaaaaataaaatagtgccacagtattttgggaattaatattcatcaaactgttgcccacatagtggtagaaatgaggcaactaacctta

SEQ ID NO: 7961 - DNA, 433 bp, Homo sapiens
aattattattactgaggggcaaggaaatcagaggttagatccagcttcaccatatgctagctctgtgatccatatcttcgttccacctgtaaagtgggaatagtaattgtgaagacaaattagatcttagataacaccataaagcactacacatcatagggtattctgatcttttaagtttcttctggactgggcacggtggctcacatctgtaatcccagcactttgggaggccaaggtgggcggatcacctgaggtcaggagtttgagaccagcctggccaacatggcaaaaccctgtctctactgaaagtacaaaaattagccagatgtggtggcgggcgcctgtaatcccagctactcaggaggctgaggcaggagaatcgcttgaacccaggaggcggaggttgcagcaaaccaaaatcatgccaccg

SEQ ID NO: 7962 - DNA, 423 bp, Homo sapiens
ttttttccttgtcatttttctctacttaattttggacacattctattgctacgtcttcaagttcactgatgatttcttcttcagtgtctaatttgctgttaatcacatccagtgatattttcatctcagagattatattttctgttatagaagtttcatttggctcttttcactagtttccatttctctcttcactaagctcatatgttccttaaaatttgtgtatatagttataatagctgttttagtatccttttcctgctagtttcatcatttctgatatttttggatctgtttctctgaaatgatttccccattggtaaaggttaccttttcctattttgtggaatgtttagagattttttataattgaatgctggacgttgcgatatttcaatgctgagtgtctggactttgtctttc

SEQ ID NO: 7963 - DNA, 943 bp, Homo sapiens
ctgggatctgggtatcacaggtagcattttatagcatcagacatgttccagtgactaactcttggctgccccatccccagacactttcctgcagtgggttggggctggggaggttgtggagctcactgatgcacattttgcagtttggctcaatgggtccacaggccttacataacctaaactccctgacttttcatcacttcctgcagaatgtgatgtgggtgggctgagggattcaagtagagactagtgggtgatacttaaacttgctcaaagggaacatcttttagggagccttctagagtgccacaaaattgggctatgactgtttctgccatctgagagagggctatcactctttctattatcttaacaagcagaagatatatttctattgtaagtagtgaagctcttcgtatcttaacattgaataatgtaggtacagtggtgtaatctcggcccactgtaacctctgcctcccgggttaaggcaattcttgtgcctcagcctccccagtagctaggattacaggtgcacaccaccacacctggctaatttttgtatttttagtagagacggggtttcaccatgttggccaggctggtctcgaactcctggcctcaagtgatccacccacctaggccttccagagttttgggattataggcatgagccaccacgcctggctctaataatgtaaaaattttaatgagtcatatttctagaattttgtttaaacacacaaattatgtgtgtgtgtgtgtgtgtgtgtgtgtgtgtgtgtgtgtttgactctctgttgccgtgagttcttgtttgaccatgtggtggtatgtgctagggtttggagaaattaatgggaaaaagagtatatgtcacatttaagtagtttttttccttctaagaattgggaaaaggcctccattgtttgattttcatggtg

SEQ ID NO: 7964 - DNA, 654 bp, Homo sapiens
ggcgcggtggctcacgcctgtaatcccggcactttgggaggctgaggcagacggatcacgaggtcaggagatcgagaacatcctggctaacatggtgaaaccccatctctactaaaaatacaaaaaattagcggggcgtggtggcgggcgcctgtagtcccagctactcaggaggctgaggcaggagaatggcgtgaacctgggaagcggagcttgcagtgggcggagatcacgccactgccctccagcctgggctacagaacaagactccgtctcaaaagaaaaaaagaaattaaatctctttaagatagggtataaacacagctttccaacaccagtgatttagtaattattccacatagagatatctgggtagaagaaataattaataaaggtcttcaaattcaggccaatagtcatattgtttattatacaaaaaataatcctctctgcacccccctccccacagtctgtggggccagattttttaagatctttatacaagaagcaagttcaccccagaggagaaaaaaaatcagaagataaatactaatccaaactaatttcctacagcttgagctcctttgaaattttatgatcagtaagagggctgaatccccagcaatatattattctagttcctctctcttaaca

SEQ ID NO: 7965 - DNA, 596 bp, Homo sapiens
ggcgcggtggctcacgcctgtaatcccggcactttgggaggctgaggcagacggatcacgaggtcaggagatcgagaacatcctggctaacatggtgaaaccccatctctactaaaaatacaaaaaattagcggggcgtggtggcgggcgcctgtagtcccagctactcaggaggctgaggcaggagaatggcgtgaacctgggaagcggagcttgcagtgggcggagatcacgccactgccctccagcctgggctacagaacaagactccgtctcaaaagaaaaaaagaaattaaatctctttaagatagggtataaacacagctttccaacaccagtgatttagtaattattccacatagagatatctgggtagaagaaataattaataaaggtcttcaaattcaggccaatagtcatattgtttattatacaaaaaataatcctctctgcacccccctccccacagtctgtggggccagattttttaagatctttatacaagaagcaagttcaccccagaggagtgaaattttatgatcagtaagagggctgaatccccagcaatatattattctagttcctctctcttaaca

SEQ ID NO: 7966 - DNA, 225 bp, Homo sapiens
gctgaacttaatggagcatcagaatgaatgacccagatcactagaaataatttgagagaatgtttagactatatatatatatttcctatggaaagaaaatgtttaccttgatcccttcctttgggtgaaaatagaagaactattattttgagaggaagttcatatcagtggggttggcttcagagtcatcaatgactcctctctgtttcttgcaacagaatttgc

SEQ ID NO: 7967 - DNA, 455 bp, Homo sapiens
ccttggtggctttggggcccttctagggaagcccctgcttcttcctagttttcaaaatcctgggagagaatctgattggctcagtatcagtcaggtatgactgtgtttggatcagtcagccctgggagagaagaggagaaataacacatagggcaaacaaaccaatttgtgtctactgtcatagaataatatttttagtaaccatcagatggggaaggcctttctaagctacttagaagatttagatgccagaatggaaaagtttgaaagatagcaaatatattaaaatgtgaaacatctttgtgacaaatgatgtcgtaaaaaagtggccaactgggagaatctatttgccataggtagacaaagaatgttccagaatatacaaacctgtgagtaaaaggtaaacaatccagtcaagaaactggcaatttacagaagaaatacagatggtctat

SEQ ID NO: 7968 - DNA, 430 bp, Homo sapiens
attcgcggccgcgtcgacctggagtgcagtggcacagtctcgactcactgcaacctcagcctgggagacagagcgagactctgtctcaacaacaacaacaaataaaaaaataaaaagtattcgtcaatttatataagaaactattattaactgttctttatagtgagaataataaactacagcacggttccaatgtcatgggtgagaaattatgattgattcatgcagtgaattatgaaattatggaaaagacggaggaggttatagatttacaatgttacttgacctgaaaaaagtccataatattttcttaaataaaatgagcaagttgcagaataacgtgtacaatattttagttgcattattttaaaaagggacacacccttttctatacctcgtcgacgcggccgcgaatttagtagtagtagta

SEQ ID NO: 7969 - DNA, 384 bp, Homo sapiens
tctggctgctttcaagatttttttcttcagttttcataaatttaattataacctgtcttagagtgttttttgaaggggtttatcctgtttggagcttgttcagcttcttgaatcctggttgatgtagcttgttaaatttgggatatatttggaggtcatttctgtgaatactttttaagccctgctctttcttcactccttgcagaactccagtgccatgacatcattttttatagtcctacgggtccttgagactttgcgctttttttttccccagtgtatttttttgttgttcagattgggtaatttctgttgttctttcagttcactgactcttttctttgtcccttccattctgctatggaaagcccatccattgaactt

SEQ ID NO: 7970 - DNA, 384 bp, Homo sapiens
caaactctgtaataactgaattggctgcataattctttatttaaaaaaaaaaacagttactcactgtagagtaacatagaaagcaagtctgtgtatcccaaactggaaggaatagaaaatattctcagccctggccaacacactagactgcttttctgacagtgctggagtggatgttgagatgtggataactaaaaggatgacagaatgtgaattttaaaagattttgctacttacaggtttttattgtttgattcctaaccccaccccctccataaaccccaaaaggtatatattctacaattaggtggaaggaaagaggaaggaagggaaggagaaaaggaagaaaggatggagagagagaggaaggaagattcacaacta

SEQ ID NO: 7971 - DNA, 991 bp, Homo sapiens
tttttgtttccttactccaaaatggtaatgatcatactactacccacctgggtggattggtgtgcatatgaaggaggtcatggggacaagtggttggaagagtgttgagcacatagaaagtacaagataaatggtggccattatgttactacttagactatatcatacttgtctttatctgggcttagaatcttgacactgagatctttcattctcagatcttaatatgaaagcttaccaggtaaacactaccccaacataattatttagtgggttcatacatgtgaaagcagttgaaatacaatttctgaactccgggttaatttatatccttagttggaacaggtagtaccctcccagcacctaaggcctctcacttctatccattcttcagatgacctttgcaataatcatggtaattgaatagcatctgcaccataacattgttgaataacatcaaaatgatccatttagccatcatgagccttcctagtaattcagactcacaccagttctttcaggttattgagtagcttttacaaataattgctaacagtacaaatactgtctcaggtattttggaagggtgaattttcccattgatttcagtgtatctttaggaggtaatttgcaaaaccgaagagtttggttccgtcaaagtcacccctaaggagtgtggaggaccacattgtaggtttatactgcactgtccctcacgcttgaaatttggctcatgcaaccaaggaactgaatttttaatttcgttaaattttgatttaaattttaaaacagaaatagtataaaatatttttctgttaaatataccttgtagtgttggcaagactacatttcgtgttaccatgctgggtaagatttcttgtagtgtgtattgtgttttgtcacctcgttaataattttcttattttggttgcatgttaaaataattttggatatattgggttaaataaatatattgttaaaattaaattca

SEQ ID NO: 7972 - DNA, 1192 bp, Homo sapiens
cggcgccaccctggccccctgctgtagctgccgcgttggttgtggtggctgggggtggtactggtgggggtgggtcccagctgcacactggcgagtgagtcggcctcttgaactgctcaggaaacatccccagatggagagagagaaacaggcagtgggtgagaccagagctcccacctgaacacagtccccagcacagcatttttgactgcaccccgagtcccaccagggcccctgtaccacttctacagcccacaggatcaggcccactcatctctactaggcaaagattccagggcaggcccagctggaaggaggcggcacccccagcccagtgtaatcaagtcaacagccagaccaaaacctgtgatcagccaacaaagtgcgcactcaaaagttctgggccaccaaaccatactgagcctgaacaggggcagggagaatgtctgagaggatatggccattgaagacggggaagaaagaacaaaggctgcatcttctggaagagaccacaaccagggcaagcactccagggagcctacgagggggctctgcggggatgagcccatgggaggctggggtgtaggagtgctcagaacaacaactctgggacacaagaagctacaggcaccaacagtgaggtctcagaagggtcccagctggtggcctccaaattctccatactgcagaaccccaatctgctcaaaatccttgaatggtttctgattgctcttaagctgaagaccaacattctctcccttcccctaggtctaaaataaacacatactccccacctctggggcaccaagagttgcagccacaccaggctggtctgttgcctcacatgcactgcactccctcttgccacagggcccttgctcctgctgcctgcactgccctccccctcgcccccctcagtgatcaactcccactcatcctgcagatttcagcttggatgtcacctcccgagggacgctgtgcctgcctccctcgtcagagcaggtgttgtcatctactcacagaatctggcttccttccacaaagcacccccgtgagcatctgtttaacattgtctctccacctagactgtaaggtccgtgaaagcagggaccacacccatttgtgctcacttgggacctacagcctctaatccagagcctgacacaaacctcaataaatatttaagaactga

SEQ ID NO: 7973 - DNA, 1084 bp, Homo sapiens
agggtaaaaggccgcccaggaaccacttggtgatggccataggtgtttcctgaagaacaaagctcccacctgaacacagtccccagcacagcatttttgactgcaccccgagtcccaccagggcccctgtaccacttctacagcccacaggatcaggcccactcatctctactaggcaaagattccagggcaggcccagctggaaggaggcggcacccccagcccagtgtaatcaagtcaacagccagaccaaaacctgtgatcagccaacaaagtgcgcactcaaaagttctgggccaccaaaccatactgagcctgaacaggggcagggagaatgtctgagaggatatggccattgaagacggggaagaaagaacaaaggctgcatcttctggaagagaccacaaccagggcaagcactccagggagcctacgagggggctctgcggggatgagcccatgggaggctggggtgtaggagtgctcagaacaacaactctgggacacaagaagctacaggcaccaacagtgaggtctcagaagggtcccagctggtggcctccaaattctccatactgcagaaccccaatctgctcaaaatccttgaatggtttctgattgctcttaagctgaagaccaacattctctcccttcccctaggtctaaaataaacacatactccccacctctggggcaccaagagttgcagccacaccaggctggtctgttgcctcacatgcactgcactccctcttgccacagggcccttgctcctgctgcctgcactgccctccccctcgcccccctcagtgatcaactcccactcatcctgcagatttcagcttggatgtcacctcccgagggacgctgtgcctgcctccctcgtcagagcaggtgttgtcatctactcacagaatctggcttccttccacaaagcacccccgtgagcatctgtttaacattgtctctccacctagactgtaaggtccgtgaaagcagggaccacacccatttgtgctcacttgggacctacagcctctaatccagagcctgacacaaacctcaataaatatttaagaactga

SEQ ID NO: 7974 - DNA, 414 bp, Homo sapiens
gtgctgttagcccagtaactaaaagttcctaggttttagttcgtaccgtgagacaaaaatttatgtatttgaatttgataatctctttctttaatattactaatgcatcagaaacactgacttctactgatagtcactgaattgtttgaattcttcactggtggtggcaacattgtctcctagagctttatatcctgttgggcagttgagctcaggtgaccaaggaagataatttaattaccatttagtcattttacgccatatacttctacattatcttcccaaaatattaaggacactttcatggctttatgtaacaccctacttcctgattccaaattctttcagttaagatgcttttgattgcaaatataacagaaaacaatactggtttccttcagcaaaaaaaaaaaa

SEQ ID NO: 7975 - DNA, 6294 bp, Homo sapiens
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaattactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattaagtaactctgggtcagtgaaaacattcgacatatattttttttggctgcatagtagtccattgagtagatattgttgttttatttaataagtacaccatggttagacataggtatctgtccaaattcccttttatagatggtgcttgcagctgaattattttcagaagatgaattctcatgagttgtattatttgtcagaaaaccacatcatttttaaaggatttatataaatattgccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgata

SEQ ID NO: 7976 - DNA, 906 bp, Homo sapiens
ccaatgatacttgaatatattaattagtactgttcctattattgtttgtttctacccatttccagaatggattagcaccagcttagagtaaaaggtacagactcagcaaattccaaaccaggattgccccatagacctcctgaagttacgcagtgtgggttctctaccctagatagttaaaacaagggtcaaagagtctaatacaagatgggtgagcagtgacagcagcatgtccaggcgaaaggatgtggctatccctgggcacacacaactggtttgagtgtcccgatagactaggctaagaaagaaataagtatgagctcctttaaagtagaaaaacttaaataatcacgtatgtacttttacattctgttatctgtcattacaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtaaaattgggttcaatgtctttcaccaagtactgtgtttatggtccttaagcagggtttctcaaccaaaatggcaagcggtgttctggatctgacagttctctgttgctgtgtgcaagttttagacagggttttgctctctcactcaggctggagtgcattagtgcgatgatagcacactacagcctcgaactcctgggctcaaatgttcctcccgcctcagcctcccaagtagctaggactacaggcatgtactactccactcagctaatttttaaatttttgtagag

SEQ ID NO: 7977 - DNA, 5470 bp, Homo sapiens
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaattactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactca

SEQ ID NO: 7978 - DNA, 2209 bp, Homo sapiens
aagtaatcctagatttcatcctaaaaatcttgattacttttctggttagactcttaaaaacacccgagcactcttgagttttttaaagtgtccttccctttgttgtgtagataactgtttggacatatctgttctcccttattctgtctgcaaaataagccaattaaagagtctgggaaaacatgtaacacttgagataattttcacccatattaaaagtctaacatagaagagttaaaatgtgctgtttttgaactaattggttgggaaacactttgttgtctgtaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattaagtaactctgggtcagtgaaaacattcgacatatattttttttggctgcatagtagtccattgagtagatattgttgttttatttaataagtacaccatggttagacataggtatctgtccaaattcccttttatagatggtgcttgcagctgaattattttcagaagatgaattctcatgagttgtattatttgtcagaaaaccacatcatttttaaaggatttatataaatattgccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgata

SEQ ID NO: 7979 - DNA, 2397 bp, Homo sapiens
ccaatgatacttgaatatattaattagtactgttcctattattgtttgtttctacccatttccagaatggattagcaccagcttagagtaaaaggtacagactcagcaaattccaaaccaggattgccccatagacctcctgaagttacgcagtgtgggttctctaccctagatagttaaaacaagggtcaaagagtctaatacaagatgggtgagcagtgacagcagcatgtccaggcgaaaggatgtggctatccctgggcacacacaactggtttgagtgtcccgatagactaggctaagaaagaaataagtatgagctcctttaaagtagaaaaacttaaataatcacgtatgtacttttacattctgttatctgtcattacaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattaagtaactctgggtcagtgaaaacattcgacatatattttttttggctgcatagtagtccattgagtagatattgttgttttatttaataagtacaccatggttagacataggtatctgtccaaattcccttttatagatggtgcttgcagctgaattattttcagaagatgaattctcatgagttgtattatttgtcagaaaaccacatcatttttaaaggatttatataaatattgccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgata

SEQ ID NO: 7980 - DNA, 1887 bp, Homo sapiens
gtcagtttgaaattacttgttagtgcttcccaaggcattgttggcaggtggtgcggcttgatctctgcccccaattgttctcacagaggtttgcctttttcctcaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattaagtaactctgggtcagtgaaaacattcgacatatattttttttggctgcatagtagtccattgagtagatattgttgttttatttaataagtacaccatggttagacataggtatctgtccaaattcccttttatagatggtgcttgcagctgaattattttcagaagatgaattctcatgagttgtattatttgtcagaaaaccacatcatttttaaaggatttatataaatattgccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgata

SEQ ID NO: 7981 - DNA, 4990 bp, Homo sapiens
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaattactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttggga

SEQ ID NO: 7982 - DNA, 6240 bp, Homo sapiens
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaattactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattaagtaactctgggtcagtgaaaacattcgacatatattttttttggctgcatagtagtccattgagtagatattgttgttttatttaataagtacaccatggttagacataggtatctgtccaaattcccttttatagatggtgcttgcagctgaattattttcagaagatgaattctcatgagttgtattatttgtcagaaaaccacatcatttttaaaggatttatataaatattgccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgata

SEQ ID NO: 7983 - DNA, 4803 bp, Homo sapiens
ggacgcgggacccgtacagcggcctccgccgcaccgggacagcagccgccgccgctgccgccgtcctcccctgtctacccggagctgtctcgagctgagccccctaccgggccggatcccgagataaagcctagccatggctgctgtttattctggcatttcccttaagcttaaaagcaagacaacttcctgggaagataaactaaaactagctcactttgcttggatttctcaccagtgctttcttccaaataaagaacaagtgttacttgattgggcaagacaatcattggttgcattttataagaaaaagcttgaactgaaggaagatattgttgaaaggctttggatctatatagataacattttacatagcagaaaattgcagaatctcctcaagaatggaaagaccattaatcttcagatttccctagtcaagatcatcaatgagagagtagctgagttctctctttcgggatcccaaagaaacatctgtgctgtccttcgatgttgccagggcatcctgtcgacacctgccctggctgtcatctacacggccaaacaggagctgatggtggccttgctgagccagctttgctggtcggcctgcaggcagcccgaaggagctgtggtagcccagttgtttgaggtcattcacctggcccttggccattatctcttgatcctgcagcagcaggtcaacccaagacgtgcctttggggatgtgactgctcacctgctccagccgtgcctggtcctgaggcacttactctctgggggcacatggacgcaggctggccagggccagctgaggcaggtgctgagccgggacatcaggagtcagattgaggccatgttccgaggagggatttttcagcctgagctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaattactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggctgttgtgtcagctgttacactgctgaggctgctactgaactgcccactcagtggagagaaagcaagtctgttgtggcgtgcgtgtccccagatagtcacagctttaacactcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtaatgctgaaagccatcccttctttcttgaactctttcaatagattggtgttttcagttatgcgggaagggcggcagaaggacaaaggaagcatagatgacctgcctacggtcctaaagtgtgcacgcctggttgaaaggatgtacagccacatcgccgcacgagctgaggagtttgctgtgttttccccatttatggtggcccagtacgtgttggaggtacagaaggtaaaattgggttcaatgtctttcaccaagtactgtgtttatggtccttaagcagggtttctcaaccaaaatggcaagcggtgttctggatctgacagttctctgttgctgtgtgcaagttttagacagggttttgctctctcactcaggctggagtgcattagtgcgatgatagcacactacagcctcgaactcctgggctcaaatgttcctcccgcctcagcctcccaagtagctaggactacaggcatgtactactccactcagctaatttttaaatttttgtagag

SEQ ID NO: 7984 - DNA, 530 bp, Homo sapiens
gaactactactactaaattcgcgccgctgtcgacaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacatacaaagatgcaatcagttttagtcattttcttccagatgtttttatcaacttacaataaacgcagaactgagatctacttacagtcttagtatgaaagtgttcgggggtccttgttaggtttggtgggttgctctttcttctgtatttataacttgtgcatttttaaaaattgtcgacgcggccgcgaat

SEQ ID NO: 7985 - DNA, 1748 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7986 - DNA, 1143 bp, Homo sapiens
cagcctggcaccagctgtctgtccccgaggccaagtctgcggcgcccactgtgtgtgtgagagagagaccgtgtggctctgggggcggcaggcgggcagctgccgagggaggactagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7987 - DNA, 1155 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7988 - DNA, 1789 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaaaaattcttacgtgc

SEQ ID NO: 7989 - DNA, 2338 bp, Homo sapiens
  misc_feature (1835)..(1835): n is a, c, g, or t
  misc_feature (2117)..(2117): n is a, c, g, or t
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaaaaaaaaaaaaaaaaaaaaaaaaaaaaaagaaaacaaagaacaacaaaaaacaaaaaaaaaaaaaaaaaaaaaaaaaaaaaaaaaaanaaaaaaaaaaaaaggggggggggcaaaaatttccccggggggggccattttccgcgctgctactcccgttttctctttggacacaaggtgggcgccccttattatgggagcggtcccggttattttattcagcccagagggagcacgtgggcgccgcggtgtgttataaacacaacgctgtgactactccggcgacaacacgctgcgctcccctgggagcactctctcgtgtggagagagggaccccccctttactcctcctgggggggggcggcgcacccnctatcgttgtgcgccaccaactacctatccaccaacggaagagattttttagagcgcggcccctcggaggggggcaacacatctcattaatccttctgcagagggcgtcccttacgtggggtgtgtcttaccccccacggcgggcatatttgtttactcgcgccgccctacgaacgaacaagtttggcgcccccacggcgggactatttgatcatcgcacc

SEQ ID NO: 7990 - DNA, 2287 bp, Homo sapiens
  misc_feature (1784)..(1784): n is a, c, g, or t
  misc_feature (2066)..(2066): n is a, c, g, or t
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaaaaaaaaaaaaaaaaaaaaaaaaaaaaaaaaaaaaanaaaaaaaaaaaaaggggggggggcaaaaatttccccggggggggccattttccgcgctgctactcccgttttctctttggacacaaggtgggcgccccttattatgggagcggtcccggttattttattcagcccagagggagcacgtgggcgccgcggtgtgttataaacacaacgctgtgactactccggcgacaacacgctgcgctcccctgggagcactctctcgtgtggagagagggaccccccctttactcctcctgggggggggcggcgcacccnctatcgttgtgcgccaccaactacctatccaccaacggaagagattttttagagcgcggcccctcggaggggggcaacacatctcattaatccttctgcagagggcgtcccttacgtggggtgtgtcttaccccccacggcgggcatatttgtttactcgcgccgccctacgaacgaacaagtttggcgcccccacggcgggactatttgatcatcgcacc

SEQ ID NO: 7991 - DNA, 1795 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgcgcatttttaaaaattgactttgaagcactaatagttatgcaaatgcttaagcaaactagaaggtacattaagca

SEQ ID NO: 7992 - DNA, 1638 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7993 - DNA, 1730 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagaacagggtcttgttttgccacccaggctggagtgcagtaatataatcttggctcaccgcagcctcaacctcctgggctcaagcaatcctcccatctcagcctccctagtgg

SEQ ID NO: 7994 - DNA, 1695 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttacattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7995 - DNA, 1259 bp, Homo sapiens
agcccgggcggggggcgctgcgggcagggccaggacccgcgcgggcgggcgcggatggagggctgcggggctgcggggctgccgggctgccgggggccctgaggtcgcggggccgccgggactgggaccaggatggggtcgccggcgggcagcgtactcggaggcccgggggcctcggccgggagcgtgggagcaggggctaccccatgcggtcacgcggggacccccgtaagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7996 - DNA, 1505 bp, Homo sapiens
gacagagacatgaaatttatttgaaatcaatgtcaagcatcggttattctaatcctggggcttggccagacctgggcgtctggaatgatctacgtgcttaaatacaccactcgccaccattttctccaggtaattttccatccctgcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 7997 - DNA, 306 bp, Homo sapiens
ggccatgcttacttatatatacttgaatcaatacgggtgccgataatagcgagggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgccgattcgctattcatcggcaccttagctctagaggtccatgcatacttaatattatacttgaattcaatacgggtgccgatgaatagcga

SEQ ID NO: 7998 - DNA, 1840 bp, Homo sapiens
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 7999 - DNA, 2164 bp, Homo sapiens
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagaactctccgtggctcgtctgtgccctgcctgcctatggaattgggaaaagcaacctgactgctatggagttcctggtctgtctgctcatggccccatcctgggggcagggcctcggttgtggacctcccctaacttggggctgtttccccattccacttgtataatggccatgatgggctctaaggctgggccctgccagctctatgtgttgaggggccatattcctaccacatttccgggtctgatcttgtgtagctcaggctgggagggccctctcagagcccaccacacccagtggcatcaatccctccccttctctctagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8000 - DNA, 1537 bp, Homo sapiens
aaacgaaatagtagtacgagcgcgtgttatcggacgaggctcggcttagtggtgtcggcggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8001 - DNA, 984 bp, Homo sapiens
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagatcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8002 - DNA, 654 bp, Homo sapiens
aaacgaaatagtagtacgagcgcgtgttatcggacgaggctcggcttagtggtgtcggcggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8003 - DNA, 1551 bp, Homo sapiens
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8004 - DNA, 1506 bp, Homo sapiens
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8005 - DNA, 1381 bp, Homo sapiens
  misc_feature (1381)..(1381): n is a, c, g, or t
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggcccagtaattaagacacttcaggaacccaaccggaatgagccggaagggtcctattttctaccttagaccacgtgaacaggcgagctgcttgaaggaaaaggccggttgaccgcaaggggtcaaacaagaggtctaatgatgccacggacgtccggagaaaaccacggggacgtgtaccctggggcaactgtgtaaacgactaagggggcgcaccccgtcggcgaattggccctagctgctggagccgaaggatgtgccacaacgagaaggccactacaggaggagacagcaacagcagctgcagaaattgaaagccaccagacacgtagacatgtagtgaccaacgactaagttcgtcgtcggn

SEQ ID NO: 8006 - DNA, 1489 bp, Homo sapiens
gcagagtttcaaatcggctgcggtgggcgaggagcagctgtgctgcggctgtgctcggccttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttgaaaaaaaaa

SEQ ID NO: 8007 - DNA, 437 bp, Homo sapiens
ccaactggaaatcctaggcagatgtaaacagattttaaaatatgttttgtggcccaggcacagggactcacgtctgtaatccccagcactttgggaggctaaggtaggaggattgcttgagcccgggagttcaagacaagccccaggcgacaaagcaagacccatttcttaactaaataattagctgggtgtgatgggatgtacctgtagtcccagctactcagagggctgaggtgggaagaacgcttgagctcaggagttctagattgcagtgagccgtggtttgccactgcactccagactaggcaacagagtaagaccctgtttctaaaacacaaaaaaatggggtttttaaaattataattaaaagtcaataatgttctttctttattggtggaagaaaggaaaagtccaaatgagttttattcaactaaaaa

SEQ ID NO: 8008 - DNA, 443 bp, Homo sapiens
aaaacccaggtgggcctggtttctagggctcgctgcttttagggccactggggtcggatcccactccacctccactgctcaccaaagcaaacaacatcaactttaccaaatattcctcttgctacagagcaagacatgattcattcagtatcactatatcctcccacacacaaacaaaggatgcaccatgatccagatttctttaggaaattagcagcttaatgaaaacttcttgaacttatatacatgatgattcttccactattttatctgtaaaagatagtcacaggaaaaatcaggcaagcacagacataggacctaaattaagaacaatagaaaattaagaacaggagtcagcaaaacttttcatgtagagaaaaaactagataagaaagaaaccatctgcaggaccaaagggcaccatttattttgaactgtactaa

SEQ ID NO: 8009 - DNA, 329 bp, Homo sapiens
agagtgcacagtcctttctcggagtgtgcaggccccagccagacagactggcacaggtgcatccgcagaaggtcctgcatagcgctgttcctcatggtgctgcttgggatggcagagaatcagagcaacgtaaatgtccgttactaggagagggggaacgaagaaacattgttcaggaaaagtaccgaaacgtggaagtaggcaaaatgtcaattgtgcagccttctaaaatcatgctcaattgtcttaaaaatagtcctgcctgggccgggcactgtaatcccagcactttgggaggccgaggtgggtgcatcacttgaggtcaggag

SEQ ID NO: 8010 - DNA, 399 bp, Homo sapiens
cactttttaaactgtgtcttttgaggaatagaagttttaaattttgatgaaatccagttttaatttctttcttttgtggtagaacctttaattttctaagaaatctttgggccgactgtggtggctcacacctgttatcccaggactttctgggaggccaaggcaggcagctcacttaagcttaggagttccaagaccagctggggcaacatggcgaaatcccgtctctactatgaatacaaaaattagccatccaccgtggcgtatgcctgtagtcccagctactcgggaggctgaggcagagaattgcttgaacccaggaggcggagattgcagtgagccgagatcgcgcgactgcattccagtctgggcgacagagtgagactccatctcaaaaaa

SEQ ID NO: 8011 - DNA, 763 bp, Homo sapiens
caggttctacttgatgtgaaatagcggggagagtgagtagattctattggtaaaaataacaaatatggagaattaacattttaaaaatgaatatataaaaagagatgtttctatgtaatataattaatttcccaaactactggcaggaagaccctttcctgaatcccacctgaacaagtgtttttgttgcttgctttccaagggtgtgtctgcacatcgactctcatcaccttctctgtctgcctctctctgttttatcgcatgacattttcattgagctattgaaattggatgtgtcagacacattaaaagcaatggcagctgtggcaagttagttgatatattttaaaataaaccaagagggccatgcagatgtcaggggaataaattgctctgtttagcaacaagtgatttatttaaccactgtagacagggtccaaaggaatgccaagctgcatacattttggttgggaaaagctgagctattttctcagaaatctctcctgtgggatcaaaataagagtgggagaagtttatgagaagattaattaaattcttgatttgggaatgaccctgaagaatgagttttatttcccatgtgcttcaaaattgacctctcagtgtttctgcaggtgagacacattctggaagcatcaggtattggcaataaccctgacttcatgggcatcactcaaactgcagcagcagcatttctctctagcttgtctttgagggcaaagtgtgatgtttccaagagagtgat

SEQ ID NO: 8012 - DNA, 483 bp, Homo sapiens
taagatggagtctcgctctgtcacccgggagtacactggcacaatctcggctcactgcaacctccgcctcccaggttcaagtgattctcctgcctcagcctcccaagtagctgggactacaagcgcgtcaccaagcccagctaattttgtatttttagtagagatgggttttcactatgttgagcgcatgcctctaaaagctatcatttagatgaggtaagacaaagcatatacaagcacctgatatagtgcaaaaaatataggagttatggaataaggaaaatctttctttcttaaaatagctgcccaagctgaagaaaggctgagcatggcttgtgttgttcttaccaggtattccagaattatttccaaaaccatccatgcaatgtttttcaatatagttctttcccttgttcatgtcttgtaacttcagatgaatcagagtaccaaggttcgaatgatcatcagacctttcacatcaca

SEQ ID NO: 8013 - DNA, 372 bp, Homo sapiens
ccagcctgggcgacagagcgaaactccatctcaaaaaaaaaaagaaaaaaaaaaagaattgtccaatgaggtaaaataaaatcatatagttgaaactactgccaagtacagtggctcatacctgtaatcccagcactcttggaggccaaggcaggcagatcacttgagcacaggagttcgagaccagcctgggcaacatggcaagaccccgtctctacaaaaaaatataaaaaagtagctgggtgtggtggtgtgcatctgtgtgaggctgagatgggaggatcacctaagcctgggagatccaagctgtagtgagcctcagtcatcacaccactgcactccagcctgggcaacggagtgaggcctgtctca

SEQ ID NO: 8014 - DNA, 630 bp, Homo sapiens
cgttgaatgtttcgtgctgcctgctggacgtctcagttggatgaccctttgtaaacattggattctataagtgtaaaactgagcttagcttgaaagcaggacagagaagagattaaaattgtgggctctagaatcaaacctgattcttccagttactagtaacattgccatttctcatgtgtgaaatgggaacagtgacctcacagggtcattgtgagaattaaattcacagtacctagaacagtgccaggtatggagtgagtcccccgtggttgttagctttggtgagtgtcaaccactgccctggcctctcccaccttgagcaccagcactgctacagctgccactccccagggcccctccttccccactgctcttctcatctcagtgaaccacagcaatgcgaggcaacactcagccctcgatgtgtccagggtgccagggcaggcatcttacttgtcgtgtctcacttgatcctggctacagccctttgaggtggggcctgttacattcttcagcctttacagcaatgaagcatccaaggttaaataacttgttcatggtctcagaacactagaatttgtattcagacctgctgatctctgggctcagtctctttgtagttatgtt

SEQ ID NO: 8015 - DNA, 744 bp, Homo sapiens
gtctggacttccccacatcctgctttcatcagctctaagactaggtggtgacatctgcttctcaataaccttcaccaggcttgctgtgaaggtcacctgagataagagacgtgaaaggatgctgaagatgcaaaagcctaagccaggcagccctgcttggcctggcctcctggaaaggggcaatgccccagcccagcacacaaccagggcctcatgatgacaattctgcaaaactggtccttggctcgtcctcccttgccaggatgagactgtgcaaagccccacccacaggcagctgctccaggtgtcgtttaagggctccaaattccttccaactaaaagtatctttccatccctgttggtatagtggttaggggaaaaaaaattaaaagaaaatgaacaatgtattttccacgtcaagatgcctgaacttcccataacagctgtcactttaagaagccataagagaaagggccaggtctccatgggtcattattcttaccaggcggggtcaacttcctctattaacacccatgcacgtatcagaagctacccatgaaaggccaagggcctacagcaaagctcccatgactggaaagtatttaagcataaggaacagaatagtttcgagggaaggacaagaaagagagtcgggaaggctgggcagaacactacttggacaactaaaaaagcaagtggggacatctcaaagagtgggctggcgtcgacgcgaacctgtgtaag

SEQ ID NO: 8016 - DNA, 914 bp, Homo sapiens
gcacctgggacaacaggcttgcaccaccctgcctggctaatttttgtgggttttttggtagagacagtgtctcaccatgttgccaaggctggtctccaactcctgggctcaagcagtcctcccactttggcctcccaaagtgctgggattacaggcgtgaaccaccacacccagtgaggataattatttttattgcctgtaagtttaatattctaagtagaacaatactttttttcacttttttcctccttttaaaaattgagatataatttagtgaaactgtatatcagttctcatgtgtagaatgcagtgagtttgacaattgtatacacctgcatagttcacgtttctatcaagatagagaacatttccatcatgtcagaaactccatttgtgtgctttatcagtcattcctttcccaaccctgccagtctctggttaaccactcttctgattcctgtcccataggtggttttttcctgttccagacattcatataaaccataatcatacaggagtattcatgtttaaaaacataaatattttctattcatttatatatcaggctaagtggtttcataggctaatttgaaaatttgtaagaatatctcataacagtaacatactgcagtgctagtcttattatttagagaaatgtaagccactgactctactttaaggaaacaacctataagagtgcagattgccttcagctaactgtggtactactcttattaggtgtttgtatgctattttgataaatatctttccaaaattttcaagaagccagcgaaacagattgaagaaatgtcttctacatatatggtttggctttaatagctcatcagaaacaggatagtgttatatttgaatcttttaaaataaagttcagatagttcaacaatgactaaaaa

SEQ ID NO: 8017 - DNA, 413 bp, Homo sapiens
aattactcaccctatttctctaaaaggctgcagtagacacatgagtgccaagagaggagcaagaaacccaaacattactgatctcaggccactgtggacacagatgcgcagaccctgatggcttgggtccccatgcacaggctgcagagggaagcccagggactccccctgctcccttcaactgttccaggattttcatttttccacatcctaagtcacattcagctcatcttgtcatagattaactttaaaatgtagcaattcagcttggagagggagagagagagaggaaaaagaagagagctggagggaatctgaaagcggcctgggagtggaagggccaccatgctgccctggacaccaggaacaggaaatcggatttgaggcagagaagctgtaggtggaaggggctt

SEQ ID NO: 8018 - DNA, 480 bp, Homo sapiens
ttttttttcttaacaacccactaaaaatgtagaaagcatttctagcttgtgagccctacaaacaaagctgtggactagagcttgctgaaccttgatctagaatatcccattactaaatattctctcacatgtcattagatatcacctaggagtggagtctctgggctacactacaagcatctgtccagctttacccatgctgtttcaccagcacagggaagttctagaatctccacatctttgtcacactgggcagtgtcagtctttaattttggctattctggaaaatatgacggtattcatttgttttttttaaattgcatttcactgatgactaacgagatcaagattcttttcatacattcattggctgtgttcctttcgtaaagttgtaaagtgcctgaacaagtcttttgcccattttaaaattggatgggcttcctagcgggtgtgtcacgcgggcgcgagtttgtgagtggg

SEQ ID NO: 8019 - DNA, 519 bp, Homo sapiens
ccgaaggcgaagaaggaagctcctgtccctcctaaagctgaagccaaaacgaaggttttgaaggccaagaaggcagtgtttaaaggtgtccacagccacacaaaaaaagatctgcacgtcacccaccttccggcggcccacgacacggcgactccagaggcagcccaaatatcctcggcagagcgcccccaggagaacaagcttgaccactatgctatcatcaagtttctgctgaccactgagtccgccatgaagaagatagaagacagcaacacacttgtgttcgttgtggatgttaaagccaacaaacaccaaatcaaacaggctgtgaagaagctctatgacattgatgtggccaaagtcaacaccctgattaggcctgatggagagaagaaggcatatgttcaactggctcctgattacaatgctttggatgttgccaacaaaattgggatcatctaaactgagtctggctggctaattctgaatatatatatatatatatcttttcaccataaa

SEQ ID NO: 8020 - DNA, 317 bp, Homo sapiens
tttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatac

SEQ ID NO: 8021 - DNA, 381 bp, Homo sapiens
tccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagac

SEQ ID NO: 8022 - DNA, 878 bp, Homo sapiens
gcgctgaaagcagagatcggagcagaccagacacagggatggttgaagctgaagatgggaatgaggttggacatgggttccaattggggatggtcctgagaattggacttttttttctgtttgtttgtttgtttttgagacagagtctctctctgtcaccaggctggagtgcagtggcacaatctcggctcactgcaacctctgcctcccaggttcaagcgattctcctgcctcagcttccctagtagctgggactacaggtgcccatcaccacgcccagctaatttttgtatttttagtgaagacgggggtttcaccatgttggccaggatggtctcgatctcttggccttgtgatccacccgcctcgacctcccaaagtgttgggattacaggcgtgagccactgcgcccggctgagaattggacactttcaactggggccctgagaggctggtggcagcacacccagggtcattcagtggggaaggtttccggagtagggacgaagatggagatggggttggcttgggatcaggagtgaggatgggaatgcagatggaatcagaggggaaatggagataagatttggaatggaggccaggtgcggtggctcacgtctggaatcccagcactttgggaggtcaaggtgggaggatcacttgaggccaggagttcagaccagcttgggcaacatggcaagaccccatctctacagaaaaaattttaaaatagctgggcatgatggcgcatgcctgtagtcccatctgctcaggaggcagaggtgcgaggattgcttgagcccaggaatttgaggctgcagtgagctatgcctgcaccactgcactccagcctgggagacagtggaaaatcccaactt

SEQ ID NO: 8023 - DNA, 320 bp, Homo sapiens
atatatcctcactttaataaattatttattatttatatattattaaattaagtattatttttataataaaaataattataattcacttaggtgatggtataacttcaaatttataattgttttacagttctaattacattacagttggggccaaagaaatccaataaccaaattaggtcatataaccaatccaataaccaaattagggcacaacttcaaatttataaaatttgaagttataaagtcacctaaatgaattataattatttttataaaaataataaataattctcatagaaatattagaaaatgcagataag

SEQ ID NO: 8024 - DNA, 442 bp, Homo sapiens
ttaatcactcgacctgaatgcatggcaaggcatttttgtcatcaaaaggatgaggtctgtggtggcttaaaatgtagctgttattatagaagagtgagttacgtcttttctttagaacagaaagagaccaaagctatctcatagaactaaaacccctcaatgacaagtgaggaagtagatgtgagaggtcacgcgacctcctgaggtcccagccttcctaggcggtggagctgtagagagggctcttcactgctgcctggcccatctggggtggcctgcgctcggggacacaggcggatgaggaggatgttgtggagcccactgaaaatgagagtcttaatggtcactaggaaaattccggttgcagactttttacatcacacttgatattaggacagcctacctacttgtttgagtgtcacagcctgatatgtaaaatagt

SEQ ID NO: 8025 - DNA, 911 bp, Homo sapiens
cagtgaagtgtgagcgtacaagatgccatggggatatgaagggagggaatggctaaccaggtcagcagacgtcacaggatgtatttgagctgagtcttgaaggggtgaatgttttgtaattaataattaatgagattttgttactgatggtgcataacatttattgaatattcacaggctctgtgctaacggctttgcatgcttttagtcctcagaactgccctctacggtatagatagtattcctaattccatcagatcaaggacatggaagctttgaagagttaggaaaatgtcctttgatcacatagtagaaaatagcagagctggggcttggacctcaggtctttctgactctaaattccacagccttaactgtcacattatgttgcacaaagtccatccattctacctagggagaaagatggaagagacttcatggggcgagtatttttggcaagtttttaggcacgaaaaagacaaggtagaagaaagatattcttggtaaagggaacagcatttgtaaaggcgcaaagttagtggttccactctgctggaactggagtagaatttctaaaatgtggtcagaatcatgtggaccacatgtcaaaattcagattctgtgacacctttcccagatacactgaattaatatctggaggtgagaagcacaaaagtttgtatggttttctccaaagttccccaagtgattcttaagcatactgaagtttgggaactgctggtgtaacacatagggttgatggtgagtggaaagaagtgagtctaaagaggtaggcaagagtttgcatcattattataaaatcttaaacttggttgggaggccaaggcggaaggatcacttgaggccaggcatttgagaacagcctgggcaacacagactgtctctacaaa

SEQ ID NO: 8026 - DNA, 546 bp, Homo sapiens
atcaactcaaattgggtaaaagacctaaatgtaagacctgaaaccgtaaaaaatactaaaagaaaacctaggaaaaactctggacaattgatctagccaaagaatttttgactaagacttcaacatcacaggcaacaaaaacaaaaacagaaaaatgggacataattaaactgaaaaacttccacatagccaaataaataattaacagagtgaacaaacaacctgaagactgggagaaaatatttgtaaactaagaatccaacacggtactaatatctagaatttacaaggaactcataacaacaacaacaataaaaacaaaccctttaaaaagtagccaaggctgagcatggtggcccatccctgtattctcagcacttggtggggctgaggcagaaagattccttgagctcaggagttggagacaagcctgcctgggcaacattgggacatctcatctctacaaaaatgaaaacattagctaggcatggtggcatgcgcctgtggccccagctaggctgaaaaacaaagtgagaccctgtttct

SEQ ID NO: 8027 - DNA, 624 bp, Homo sapiens
ggaccaagcccttctctgtctcttgggactaggtaagacctgaaattcttatacgctccaaggagatggaatggacagactagaggttcagagccagtctaatttgatatgaaaaggtaaaaaaatttgatacttcttacatctcagttctgtagaagaaactcaaacccattgtgtaattctttcacttgatatttggtataatagtcatggtcatcagctcattctgagcaggagtgctaatgaaggatgtgtgtctgtcaagtccaggctgcttcatacaactcttgtgcactccaccctctatccccccatcatcctcacccccagttcttcttttgacctgaggtctgtttccccatcattaccctgcattgtttgcctctgcccttgcaaaagagactgaataagtatctctcatgtgacagctcctcaaatatttgaaaatagttgttctgtcctttgagttaaatagcagcttttgttgattgtctgtagtctttaaattagtctgtagtctagatagtgtgagttggaatagttcctgacctcaaaaatgttttgatcttccttggggaccttgtctagatctgggaaggagtaccttgaggctgaaaaaatatg

SEQ ID NO: 8028 - DNA, 416 bp, Homo sapiens
agcaacccaggaaagatgtgaattctgtggcattaaaattcagcaactcgcaaaatttggaaaccttaacatttcacttagcaaaatacatatatagtaatgtaaaggccctgagtcttgggttttcatttcaaggtgagcatttgatattggagctgggttatttcttgttttgttctctaatattgtcagaagtaatcctactccttggtttcaacatttcccctctccttttaattgggacacccctactcgtttaccaccagcttgaacacatcacaggtaattgcaagcaataactaaaatagtagttgtgcagctatgaactgtgagcagcttgctctttcccatcctggcaattggttgtcagtttctttccttccatctgaacccagtaacatcacccacgtttcccc

SEQ ID NO: 8029 - DNA, 4859 bp, Homo sapiens
ctgatggatttgcattcaggttccagccctgcgtttcctatattgactccttatacacgacctggcgctccagtttaggaggagacgttgttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacataatacattatatatagaggatacaaagcttgaaccttaaactccagctatgccatgcctttcgtgcttccattttagaaatgatttcttttacttgttacacagaaagtaatttattaacgggtttgatgcactgtgatgttgataaatcttatatcccaccatctctagtccaaaccaggatacaattgagacttaaaatgtgacttacggtttacttttttttccttgaattatgaatttcagtcttagtaaccagtgatgcactgtttcccaggcaagatgcaagggggagaaaataaagtaactagatcgctaagaagtacaggattaattaggagaagataatctaggatccatacatcttaagataataaatgagataaagaaattggaaagtaaaattgctattgtttttaaaatatgtagtccaattacatgcacaccctcacacacccacacgcttccacacacacccacacaacccaataaatatcaaaggccgtggagccaatttagatggccagaatcctgtgaaagctgtcacttatatttggttaccattttccaaccacttacagcaactggccccaataacgcttgaactaagtcagaggatgctgaatgagtttttcgtcat

SEQ ID NO: 8030 - DNA, 4981 bp, Homo sapiens
agcgaccatttccctgcaagtctcaaaggtggaaacatttaaacggattacaagcgtgattcggtagcctttcggaaagttggtggccagaagaggagaagctacaaggctacagtatgatggatacaattcagcttcgcagagagtttgcccctcctgctgggtagcccctcgcagcaaacctcggagatcctgagcgctctgcaccatagttttgtaatcaaccacgaacgatgaaaccttccatagctgagatgcttcacagaggaaggatgttgtggataattcttctaagcacaattgctctaggatggactaccccgattcccctaatagaggactcagaggaaatagatgagccctgttttgatccatgctactgtgaagttaaagaaagcctctttcatatacattgtgacagtaaaggatttacaaatattagtcagattaccgagttctggtcaagaccttttaaactgtatctgcagaggaattctatgaggaaattatataccaacagttttcttcatttgaataatgctgtgtctattaatcttgggaacaatgcattgcaggacattcagactggagctttcaatggtcttaagattttaaagagactatatctacatgaaaacaaactagatgtcttcagaaatgacaccttccttggcttggaaagtctagaatatctgcaggcagattacaatgtcattaaacgtattgagagtggggcatttcggaacctaagtaaattgagggttctgattttaaatgataatctcatccccatgcttccaaccaatttatttaaggctgtctctttaacccatttggacctacgtggaaataggttaaaggttcttttttaccgaggaatgctagatcacattggcagaagcctgatggagctccagctggaagaaaacccttggaactgtacatgtgaaattgtacaactgaagagttggctggaacgcattccttatactgccctggtgggagacattacctgtgagacccctttccacttccatggaaaggacctacgagaaatcaggaagacagaactctgtcccttgttgtctgactctgaggtagaggctagtttgggaattccacattcgtcatcaagtaaggagaatgcatggccaactaagccttcctcaatgctatcctctgttcattttactgcttcttctgtcgaatacaagtcctcaaataaacagcctaagcccaccaaacagcctcgaacaccaaggccaccctccacctcccaagctttatatcctggtccaaaccagcctcccattgctccttatcagaccagaccaccaatccccattatatgccccactgggtgtacctgtaatttgcacatcaatgaccttggcttgactgtcaactgcaaagagcgaggatttaataacatttctgaacttcttccaaggcccttgaatgccaagaaactgtatctgagtagcaatctgattcagaaaatataccgttctgatttttggaatttttcttccttggatctcttgcatctggggaacaatcgtatttcctatgtccaagatggggcctttatcaacttgcccaacttaaagagcctcttccttaatggcaacgatatagagaagctgacaccaggcatgttccgaggcctacagagtttgcactacttgtactttgagttcaatgtcatccgggaaatccagcctgcagccttcagcctcatgcccaacttgaagctgctattcctcaataataacttactgaggactctgccaacagacgcctttgctggcacatccctggcccggctcaacctgaggaagaactacttcctctatcttcccgtggctggtgtcctggaacacttgaatgccattgtccagatagacctcaatgagaatccttgggactgcacctgtgacctggtcccctttaaacagtggatcgaaaccatcagctcagtcagtgtggttggtgatgtgctttgcaggagccctgagaacctcacgcaccgtgatgtgcgcactattgagctggaagttctttgcccagagatgctgcacgttgcaccagctggagaatccccagcccagcctggagattctcaccttattggggcaccaaccagtgcatcaccttatgagttttctcctcctgggggccctgtgccactttctgtgttaattctcagcctgctggttctgtttttctcagcagtctttgttgctgcaggcctctttgcctacgtgctccgaaggcgtcgaaagaagctgcccttcagaagcaagcggcaggaaggtgtggaccttactggcatccaaatgcaatgccacaggctgtttgaggatggtggaggtggtggtggcggaagtgggggtggtggtcgaccaactctttcctctccagagaaggcccctcccgtgggtcatgtgtatgagtacatcccccacccggttacccaaatgtgcaacaaccccatctacaagcctcgtgaggaggaggaggtggctgtttcatcagcccaagaagcagggagtgcagaacgtgggggtccagggacacaaccaccgggaatgggtgaggctctcctaggaagtgagcagtttgctgagacacccaaggagaaccatagtaactaccggaccttgctggaaaaagagaaggagtgggccctagcagtgtccagctcccagcttaacaccatagtgacggtgaatcaccatcaccctcaccacccagcagttggtggggtttcaggagtagttgggggaactgggggagacttggcagggttccgccaccatgagaaaaatggtggggtggtgctgtttcctcctgggggaggctgtggtagtggcagtatgctactagatcgagagaggccacagcctgccccctgcacagtgggatttgtggactgtctctatggaacagtgcccaaattaaaggaactgcacgtgcaccctcctggcatgcaatacccagacttacagcaggatgccaggctcaaagaaacccttctcttctcggctggaaagggcttcacagaccaccaaacccaaaaaagtgattacctcgagttaagggccaaacttcaaaccaagccggattacctcgaagtcctggagaagacaacatacaggttctaacagagagaagaaaatatattagtgctttttttttttcaaaagaaaaggaaaataaaagaaatatatcccttgctccctttacacttgtcccagtaactccatcctcacgatctttcctaccctgaacaaaactaaaaccgcatgataactagagaatacagatgtatgctctcccctctcagatgcgatttggaggaagggccatactcagatcattaatcaatgaaagtgccttcgcagacttttgccagcaaatgttatcattatttttttatactgaaacttgagactttgactgtgccatgtataagatatactggggatcattgtatggatcctaattaagtaaaattcaatgtgtctttttattttcagtaactattttttttatagttgtagttttgatttaaagggggggaaacaagttgacatttgtcatttgtggctttctttcttatcatcatggcacagattctgtacatgtattaacaatgcagtttgctgcatgcctggaaactgcaagatggggagggagggggcgggtcttgctcgaatgttctcactcactatcttgtctctcatacacatatccatctgcagaccatggtccctaaacctgcagtttcttcctgctggtgcaggtacacacacacacacacacacacacacacacacacacacacactccataccatttccattcaactcaatctgcttagttcgggtttgatccatttttctcctctccatagttctaccacccttcactgctagtgtacagctcacagcatctctcctaccaccctgggaaaagtcacattctaggctggattctactgaagtagaggcctggtggtttaacagccgaagacacacgcctagggatgagcaccctctttgtgacacttcatcctgatgccaagattttttggagaacatctgcactttcttatatatatatataatattaaaaaaagcaactgggtatatatcactaacagctttgtaggaagcacttttaatgttttctctctcacacacaaagattcaaaagaaatgtgcatatatttattctgtaatttcagtgattataaattgtaaaggtaatgtttaatcattgtatagtgattatgcctctggtatagctttcctaataaaaagtttttgaaaaacataatacattatatatagaggatacaaagcttgaaccttaaactccagctatgccatgcctttcgtgcttccattttagaaatgatttcttttacttgttacacagaaagtaatttattaacgggtttgatgcactgtgatgttgataaatcttatatcccaccatctctagtccaaaccaggatacaattgagacttaaaatgtgacttacggtttacttttttttccttgaattatgaatttcagtcttagtaaccagtgatgcactgtttcccaggcaagatgcaagggggagaaaataaagtaactagatcgctaagaagtacaggattaattaggagaagataatctaggatccatacatcttaagataataaatgagataaagaaattggaaagtaaaattgctattgtttttaaaatatgtagtccaattacatgcacaccctcacacacccacacgcttccacacacacccacacaacccaataaatatcaaaggccgtggagccaatttagatggccagaatcctgtgaaagctgtcacttatatttggttaccattttccaaccacttacagcaactggccccaataacgcttgaactaagtcagaggatgctgaatgagtttttcgtcat

SEQ ID NO: 8031 - DNA, 462 bp, Homo sapiens
attcaataaaccagccacagacgttatcatcagatgtgcccagagacaaggtggacaggggcatttgctgtggagaccagagggccagagagagtacagggacctggatagatggctccagcacctcttcttctcccctacacccatatgccatcttgataaacagcagggaaatctgaaaaataccaagtcttcccatagggacagtgttacctcccaaaaactgtttgaataattggcttgaactggattttctgaactgaactaatgctattgttttgtgggtttttttcttcctactgagtagagtagttgtttatgggggacatctgatcctttcattttcttccagagagctaaccacctgttctgacaccatttattgaatagtacctcttttcccccactgatgtgagaggctgcatttttcatctaataaaatcgaatatatatttagatcta

SEQ ID NO: 8032 - DNA, 446 bp, Homo sapiens
cactgccctttgcagcaccagctgattacattgctttttccatgttctagctgttcttttgagccgttttatagccgagcatctccaccagaagagcggataggaaaaaggaaaagagaggaggatttgaccttggtatcttgcttcatttccttctctgacaaaaatttggtgaaaaggttaaaataagttgttacctcccaaaaactgtttgaataattggcttgaactggattttctgaactgaactaatgctattgttttgtgggtttttttcttcctactgagtagagtagttgtttatgggggacatctgatcctttcattttcttccagagagctaaccacctgttctgacaccatttattgaatagtacctcttttcccccactgatgtgagaggctgcatttttcatctaataaaatcgaatatatatttagatcta

SEQ ID NO: 8033 - DNA, 399 bp, Homo sapiens
caagaaatttttaaaaatacagaaaagctcaaaatttttaaaaatacacacacaaaaaaaatcaccctaaacctattattctgctacccagaaataagcattgttaatattttggtgggctttttctatttctatttagggagagctttcaacatttcaccgttcagtatgatatcgattgcagattttttttatactctttatcagtgtaagaaaactccctcctattcttagtttgtagaatttttaaaacagctattgctgttgtccacaggaaagtccctttgtgtctgcactattttaatcccaaaataaagaaaaatctgctaattccacaggtggttatatagatgctggggtttcagcacttcctgtttgaccggaaactctcagtgaagt

SEQ ID NO: 8034 - DNA, 301 bp, Homo sapiens
  misc_feature (283)..(283): n is a, c, g, or t
atgaagagcacaagctggatgacaggagtcttttggagcagttctgagaaggaattgacaaagaggtcataggacagcagcaggaactgcagagagagcaccaggctgtagttactggtctggagcatcttccttctgttttctcggcgcccaagggcacatcccacagttcccagaaaaccgctcctggctgtctccctaccactgagggagaggcttctagttcctttgaatgagagctgtttcccttgctctaaggcaagcacctccaaactccaactgncgttgtcacctcgtgccg

SEQ ID NO: 8035 - DNA, 294 bp, Homo sapiens
tgtctccttgacaaatcctcatctaacctttgcctaaatatttctagagatagaggcttgctactacatactgagaaagccatgtccttttttcactagctctaattgtcacaaagttttctcgtattgatctgaaaactctagcagatttatcacttgagcaagaacatgaacgctcaactgcagttaacagtagatctagacctctgcatatttttacattgggttgtagtaaaacctttctctctaaagatcccagtgtttgcaaacagttttactgctgccatgtgatgg

SEQ ID NO: 8036 - DNA, 445 bp, Homo sapiens
tgaaaaacatacttgaacacagagctgggagttttgacaggtaggctttaggagctttgtcaccaccaccaggacacagggatctcccggcaaggtgctcagggacctgtggggcccagaggccagggggctgggagggcctggagtggccagcagggaggctgcagagccatgcctcctcctcccctaatcaccccagcagaccttcctctgagaagcagcagaccagggagggggcatgtgtcattctctgccagtcactttcttctccactccaccacctatgcatttaacacagaaagtgcatgaggccacgctgtctgcagtcagccaccgccactgctccatccaaggactctgcactggaggccagcaggatgccctgggcttcctgcaggggctaagccatgcatgggtcccagtgcagtcaaggccccaaggcagt

SEQ ID NO: 8037 - DNA, 432 bp, Homo sapiens
ctcttatccacaccttaccccctaccttggatttgttctacagtctccataaatctaattaaatagagctgatgtctctcctactttccaatttcagttggtaagctgaagtgagagcgaggcatgctctctgaaactaacttctgatccttttacccacttaatcccttttactaggattctgatacttccagatttggtcaaaattacctctaagacctcccctaacatgaatgtaacagaaatggattaagtctatgttatgagaggtgtccatgaaaaaagataataataagaaacgggacaggcaaataaatgcttaacaagtattccttaatggcaggtgatactgaaatctattttctagccactcactaggtctttttgctaaagcatttttttcagaatctggggctatgtctatagcggccg

SEQ ID NO: 8038 - DNA, 406 bp, Homo sapiens
tctctctgaactagcaatttatcatacttccattcctcctaatcaaatggtttggggaataatagaaagcatatgcatagtaaaaacttaaaagtgcaaagctagatgcttcagatagtagtcctcatttccttaatgaccacgcacatattcataacacagcattttatacaaatcaggctaaagtacaatctcaaaagaccctggtgctttcaacgtttgaaaaatgagtgcccataaacaatatcaaatcacaatataacttgataattataatgtttatatttcacttattaaatacagaaagactgtttggtcttaaatataggtggtactttcacccttgaatgagaaataaatttatttatttagcaaaaataaatttatatgagaatggaattttgta

SEQ ID NO: 8039 - DNA, 397 bp, Homo sapiens
gagtgaaatgtcccacgagatgggaggagagcagaggtgtgcaggctgagtgaatcagcttccaggagacaggagtcaaaggtggtgccaggcagagaaaggtcatagagttaggaattgcactaaacacagcctgattaggctctggcacctactagctgggaggcctcttgaagtcacaatggcccacttgtaaaacagggacaatatgaccgctgttgtaggactgctggaaggtagagctaatgcctaacccataccatttattaataagtggtaaagacaattataatcccatccttagaggatggttgagttccgctaggaagcccggagagggaaggcattcctgttacgggagattttaaggtggcatttaaggtggggaggggggggc

SEQ ID NO: 8040 - DNA, 423 bp, Homo sapiens
gaactcctgagttctcaattttactatttgattgctactggtaacttgctcaccaaaaggctctaacagtttcactcctgccaatactgaataccaccaccacgcccggctaattttttgtatttttggtagagacggggtttcaccatgttggccaggatgatcttgatcccctgacctggtgatccgcccgcctcggcctcccaaagtgctgggattacaggcgtgagtcactgcgcctggcctcttttattattattactatttttttgataaaaggtactgtaccattgtttaaattcatttttctctagtttcttggtgaggctgggcacctttcctttttgtttttgtttttgttttttttgagacagagtttcactcctgttgcccagcctgggcgataagagcgaaactccgtct

SEQ ID NO: 8041 - DNA, 514 bp, Homo sapiens
gaactcctgagttctcaattttactatttgattgctactggtaacttgctcaccaaaaggctctaacagtttcactcctgccaatactgaataaaaaaaaaaaaaaaaaaaaaactgcagtaaaaagccagctgtacctatacatgatgtacctacttgtatgcatagccttaagtatacctatagaataaattcctaaaagtggaattgttggtgtaggcattaataaatcttgtcaaattgccctccataaaggtttctgccatttttcattctgaccaactacatgtgagaatgtgtatttcctccaaaacatcaatatttgtgtttttaaataaaactacttgagagtcatgtttaaaaaaacaaacaaaggtcgatcgcgacggcgtagatgataattatttttttggagaaagaggtttcgcccggttgcccggctgggagtgcaatgggcgagtctccgctcaagggaccctccacctcctagggttaaggcatttcctggcccggc

SEQ ID NO: 8042 - DNA, 785 bp, Homo sapiens
acctggtgattgattagaagtgaaggtcaacaaccctaattaatgcctccttcttgggaataagcaaatcatagaaagtttgtgcatggggaacagggagactccaggggcagtggagaggcagagaagagtggtatcatgggagcacacagaaatctctgggcatcccctcagtctagctgtggacagtgccctcgttgggctgggaaaggttgggggagagagagctcaccaggaacatgtactaagttgttccatttttactgatgctgatttctattcattcttttgccttatattgtagtaagtgtctactaaatttagatttagtgaatagtctaaatctaaaactctataaattcacttttatcattgtaatttgccactgagaacccaccattcagaacaacagtccaacttcaaattgcttcagtgattatattgttaatatttcctagcttccagaattgaatctcatgaaattcatggaatttggatcaatgtgtgtgggtactgtggtgatccattccctcctgtggactatttctcctttctgaactgaatgcttctttggttttatgtctactcattaatgactacatagtaacccacttctgacaaaggccagtctacactgccaaagtgtttcacttagcatgcctcccagtggaagcagaggtggaatccaaagttttcagttcatgttgctgattcattcaagttactgaagaaatgtccagagactagagactgtggaagttgtttctgttctgtgaaaaaaaaaa

SEQ ID NO: 8043 - DNA, 372 bp, Homo sapiens
cttacccttaatggcatttgcaagttctaaatataggctggaatattaataatcctcagcccctgctaaaaggcagataatctaagagagctcttgataattcataagtcgaggtggacaaaaaattataggttgatgctgtgaaggcagccaggatttatgagtacaagcctggagagaagagaggtgtgaaaaagtaagcataatactaaggtcattttcctataaaagcattttctgaagtaagctgattagagtgagaggctaggaagccaagcatacagccgttgaaaatccaaatcagagtttttaaacatcttttagtgctgagaagacaaaactggaggccatgactcactaagggagaggagc

SEQ ID NO: 8044 - DNA, 260 bp, Homo sapiens
tttttttttgagacagggtctcaccgcacattcaggatggagggcagtgtgaacatagcttactgccacctcaaactcctgggctcaagggatcctccagcctcagcctcctgagtagctgggactacaggtgcaagccaccacgtctgctaattctttaacttttttgtggagacaagctatcattatgttgcccaagcgggtctcaactcgaactcctggcctcaagtgatcctcctgccttggcctcccgaagtgct

SEQ ID NO: 8045 - DNA, 599 bp, Homo sapiens
atatgttacagttgcactcaaaaatcgtggtgactcaacacaacagaatgtaaacccaatcaggacgggggtggctctgctccatattgtaggggaccagggctttgctgtcttcgttggtggctttccaggcctccctgggtgttaacatccagcactcagacagtcacagaggaatgaacacagttgtttgtaatggcggccaagatcgtccaggcccggaagttgtgactatcactttcactgacatttcactggccagaagtcagccatgggccacacctgtctccaaaggaggttgagaaatgtagtccagctgagtaccctggaggacgggaccaggctgtggtgggacagttcagtcttctctagcacagcggtctccaacctttttggcaccaggaatcagtttcgtggaagacaatttttccatggaggaccgagaggggatggttttgggatgaaattgttccacttcagatcatcaggcattagattctcatcaggagcatgcaacctagatccccagcatgcacagttcacaatagggtttgctcccatgagaatctaatgctgctgctgatctgacaggagctgga

SEQ ID NO: 8046 - DNA, 452 bp, Homo sapiens
cccgtgcctccaatttggacgtgataaaacagcgtcgtaaagttttcaccccagagttctctgcttagtaagaagtagaaggaagtctaaacctaagtcatctgatttcagagcccatataattaaatgctctaaatgcagattcccagggtggtggtttctatgagagcctgtcacatacgatgtaggacactgcttctctgtaacgtgtgcaagattcccttgatgatggtgactatgagagcctgtcacatacgatgtaggacagtgcttccctgtaacaggcgcaagattcctgtgatgatggtgactatgagagcctgttacatatgacgtaggacagcacttctctgtaacatgcacaagattcccgtgatgatggtgactatgagagcctgtcacatgtgatgtaggacagtgcttcctctgtaacatgcacaagattcacccgg

SEQ ID NO: 8047 - DNA, 519 bp, Homo sapiens
tgctttcctcaggtgaccttaaccagccttatggttttaactcttacctatatactgacattgcttaaatccttgcccttagactagaattttcttcagattttctattttctgctgcctcccaaatctctcctaggctgtgaaaactcacattttcacatccttctctgagtcagtttttcctctcatatgtttctagagtccttgaccccttggtcttcttgtgctgttccagttcatgccctcatcgttttttatgtgatgtaataactcagcttcttgattggtctctatgcacttctttttgctaccatttctttgtagctgaaagagtgacttatttaaaactcaaaatttgtgcatattgcttacattcctatttaaaatctgtcatgaaggctggggcagtggcttacgccagtaactctaatactttgggaggttgaggcgggaggattgcttgaggctgggagttgaggatcagcctgggcaacaaagtgagatcccatttctacaaaa

SEQ ID NO: 8048 - DNA, 882 bp, Homo sapiens
acctctgggggtggggagtaggaataaggggccttggggcctccataaatctgcaatctgcaccctcctcctagagacagggagatcgtgttctgctttttacatgaggagcagaactgggccatacacgtgttcaagaactaggggagctacctggtagcaagtgagtgcagacccacctcaccttgggggaatctcaaactcataggcctcagatacacgatcacctgtcatatcaggtgagcactggcctgcttggggagagacctgggcccctccaggtgtaggaacagcaacactcctggctgacaactaagccaatatggccctaggtcattcttgcttccaatatgcttgccactccttaaatgtcctaatgatgagaaactctctttctgaccaattgctatgtttacataacacgcatgtactcatgcatcccttgccagagcccatatatgtatgcatatataaacatagcactttttactacatagctcagcacattgcaaggtttgcatttaagttaaaaaaaaaaaaaaaaaaaactaaaggtgaaagatgccacattgaacaaactaaattcccaacccggttctggcaaagaatccagttatcccttccatgaagacgcacataactctcttacttggtctttccattagggacaacataagtcttgttttacatcaaataaaaacaatgttaaaaagtgtgtgaaccttaaaaatggaagtctactagtttacatacctacttcagaggacatggaaatgaccatgggcctgcatttcagggaccaaagcaaattaggcctggcctaaaatacatcagaccttttgtaagagagaatttcaataaagcaaaaaacatgtcacaaga

SEQ ID NO: 8049 - DNA, 461 bp, Homo sapiens
agagacagggtttcaccatgttgcccaggctggtctcaaactcctgagctcaaggtgtcaatcttacttgtggaaagtacgatttcatgtggacatgttgttcttgcaccttgttttgtacggataggaagactgactattttcctatgaaacatcaaaggtcttgtagcccctgtagctgtatccctccagtggcagtgatcagaagtaagtctacaggcttgaataaggcctggtctcctctgtcttgcagctatatggtgaacccacactgcagtcccacctccctttataccagtggtcctcaacctttttggcatcagggaccagtttcatagaaggcaatttttccatggaccaggggtggcaggggtttgcaggatgagtcaagcacattacgtttatcgtgtactttatttctatgatttattacattgtaatatataatgaaataattatac

SEQ ID NO: 8050 - DNA, 348 bp, Homo sapiens
agagacagggtttcaccatgttgcccaggctggtctcaaactcctgagctcaaggtgtcaatcttacttgtggaaagtacgatttcatgtggacatgttgttcttgcaccttgttttgtacggataggaagactgactattttcctatgaaacatcaaaggtcttgtagcccctgtagctgtatccctccagtggcagtgatcagaagtaagtctacaggcttgaataaggcctggtctcctctgtcttgcagctatatggtgaacccacactgcagtcccacctcccttggatgtttcataggaaaatagtcagtcttcctatccgtacaaaaaaagggcggccgcg

SEQ ID NO: 8051 - DNA, 408 bp, Homo sapiens
tgtcttgggaagtttataagaactaattgcagtggcagctcatactgcagctataagctatagaaataatcttttgggtcataatattaaaaatgtccaaaggcagctaaacagcctttggaaataaatgaggctgctttgatttttacctgtgacaatgcacaaatctggcattttctgatttggaaaagttctgagtctggaaattaaactgtcagagttgaaaagtataggaatgtgaggaccaaaagctgtttaatcaaagtgctggatactttttcaaaagggataggaaatagattgtccaataacaatggtaactgtgtgaaatgcatcttcggaacaaggagagatggaagaagaggaagaaggcaagagaaactggagattgctttcccaattgttaaa

SEQ ID NO: 8052 - DNA, 248 bp, Homo sapiens
gcgtcgacgtacaacaaccccgcgtgacacgtttacctgtgtaacaaacattcacatgtaccaccaaacccaaatttcctcctgcaatgggatgtggtctgttttcaggggttgaacaatccctagacttccgttcaataactcaccataatgtcagttccacatggctgggagacctcaggaagcgtacaatcatggcagaaggggaagcagtcaccttcttcacttagtcatcttcgtcgacgcgg

SEQ ID NO: 8053 - DNA, 214 bp, Homo sapiens
ttagtttatgaattcagtcatggcatttatttccttttaggcccatgtatccagaaaagccaaattctttcagttatatatgcaagtcacagatgattctatgtggttttctttgcatatataactgatacgattcatgtatttttaagatagtaagtttgtaagaaaaatattctcctcttaaaagtcaaacaacttgatgagcttccagaaa

SEQ ID NO: 8054 - DNA, 351 bp, Homo sapiens
  misc_feature (244)..(244): n is a, c, g, or t
  misc_feature (293)..(293): n is a, c, g, or t
  misc_feature (299)..(299): n is a, c, g, or t
cccccctataggacttggacagaaacccgagggtcatctttgactttttctttctctttaccacccctaccaaaatgccaccagttgccaagttttgtcagttcaacctgctgagtgtcaggagagagcttcacttctttatcctctcaccaggataatacatttctgagttttaatatctaatgtgacattttaactgagtacctacttttttttttttttgagacaggagaaaggcatgaanccaggaggcagagcttgcagtgagctgagatcacgccattgcactccancctggncaacagtgttaagactctgtctcaaatataaataaataaataaataaataaa

SEQ ID NO: 8055 - DNA, 4123 bp, Homo sapiens
  misc_feature (6)..(6): n is a, c, g, or t
  misc_feature (8)..(8): n is a, c, g, or t
  misc_feature (1927)..(1927): n is a, c, g, or t
ggccgngnctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattccttacctgtctgccctcatgatttgccagcatgaattcatgatgctccacactcgcttatgctacttaatcagaatcttgagaaaatagaccataatgattccctgttgtattaaaattgccagtcccccaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctctgctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcngcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggttttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacatgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccaccacacccggctaattttgtatttttcagtagagacggggtttcgccacattggccgtgttggtcttgaactcctggcctcaagcaatccgcctacctcagcctcccaaagtgctaggattacaggcataagccactgagcccagccctagttcagtatcttttatgtaaattataaacatctgcaacattatgtatcatatgcagatacttattgcatttcttttattagtggtgaaagtgttctatgcatttattggctcttgaatttcctcatctatgaattgtcattcacacacctacttttctgcttcgtttttacatatgtctttgcctattaaagatattatccctctgttttatattttctctcattcttgtattgccttttaaattttgttatgatgtttcattaataaacagtgttttgttttcctctataatcaaa

SEQ ID NO: 8056 - DNA, 4146 bp, Homo sapiens
  misc_feature (1950)..(1950): n is a, c, g, or t
gaattccggtgaagttgaccgggtccacccgaagcttgtgcgcgtgcaggtcgctcagggcggacgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattccttacctgtctgccctcatgatttgccagcatgaattcatgatgctccacactcgcttatgctacttaatcagaatcttgagaaaatagaccataatgattccctgttgtattaaaattgccagtcccccaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctctgctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcngcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggttttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacatgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccaccacacccggctaattttgtatttttcagtagagacggggtttcgccacattggccgtgttggtcttgaactcctggcctcaagcaatccgcctacctcagcctcccaaagtgctaggattacaggcataagccactgagcccagccctagttcagtatcttttatgtaaattataaacatctgcaacattatgtatcatatgcagatacttattgcatttcttttattagtggtgaaagtgttctatgcatttattggctcttgaatttcctcatctatgaattgtcattcacacacctacttttctgcttcgtttttacatatgtctttgcctattaaagatattatccctctgttttatattttctctcattcttgtattgccttttaaattttgttatgatgtttcattaataaacagtgttttgttttcctctataatcaaa

SEQ ID NO: 8057 - DNA, 4094 bp, Homo sapiens
  misc_feature (1950)..(1950): n is a, c, g, or t
gaattccggtgaagttgaccgggtccacccgaagcttgtgcgcgtgcaggtcgctcagggcggacgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattccttacctgtctgccctcatgatttgccagcatgaattcatgatgctccacactcgcttatgctacttaatcagaatcttgagaaaatagaccataatgattccctgttgtattaaaattgccagtcccccaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctctgctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcngcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggttttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacatgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccaccacacccggctaattttgtatttttcagtagagacggggtttcgccacattggccgtgttggtcttgaactcctggcctcaagcaatccgcctacctcagcctcccaaagtgctaggattacaggcataagccactgagcccagccctagttcagtatcttttatgtaaattataaacatctgcaacattatgtatcatatgcagatacttattgcatttcttttattagtggtgaaagtgttctatgcatttattggctcttgaatttcctcatctatgaattgtcattcacacacctacttttctgcttcgtttttacatatgtctttgcctattaaagatattatccctctgttttatatttttagaggaaaacaaaacactgtttattaa

SEQ ID NO: 8058 - DNA, 1022 bp, Homo sapiens
gaattccggtgaagttgaccgggtccacccgaagcttgtgcgcgtgcaggtcgctcagggcggacgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggtgggggaagctttttaaaatcctgctagtttgatgaagaagttgaatggaaagatttaactttgtaaaagtgtaagtgacataagcgtaagccaaaaggaatttgaaacttaaagtatttctgaatgaatttcttaactcagtagaaaaaaacggaaggagtaaaagatatttgctgcatatatatattatatatacgtatatataatatatatatatatatgtagtgttttatcactgctcttaactgcctttgataatttctcataaaccattgctgccacctagttttggaaactaaagatcttcctataagcccaatttacttggctagaaagcaa

SEQ ID NO: 8059 - DNA, 1952 bp, Homo sapiens
cgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctca

SEQ ID NO: 8060 - DNA, 1855 bp, Homo sapiens
cgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctca

SEQ ID NO: 8061 - DNA, 2395 bp, Homo sapiens
cgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccactcactcgttcccaggtcagaggtcagcagatgggtgtttctgggtgggccgtcaggcatgggcctgtgcaacacagagcccgttcctcaggcgagtggtgctgaggtgctctgtggtgatgggaacggcagaggctggcaggtgactgaacttagcccagggcagctccacatcctgggaacactttcatgtaaccccttctagttttgaactctgcagcaggctggtgctgtgtagtggccacccagtcaccacccttggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctcaagtaagcattccttttgctctctttaagacctcacagattctgaccttagattctgtgacaaactgatacaggagctgggctggctatggctttaccacaacaagtaggtttgcttaagaaattactaaacaatggctgggcgtggtggctcactcctgtaatcccagcactttgggaggccgagatgggcggatcacgaggtcaggagatcgagaccatcctggctaacagggtgaaaccacgtctctactaaaaatacaaaaaaattagccaggcgtagtggtgggcgcctgtagtcccagctacttgggaggctgaggcaggagaatggcgtgaacccgggaggcggagcttgcagtgagccgagatcacgccactgcactccagcctgggcgacagagcgagactccgtctcaaaaaaaaaaaagttactaaacaaggc

SEQ ID NO: 8062 - DNA, 1588 bp, Homo sapiens
cgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagggtgtcagggtctgggctcgcatgcaccctgctcccttctgccagcctgcatcctctcctcaggcctccttcccacatcatctgtcttctctaagttagggaaccatatttgagactttcaaaaagggaacttctaggtttaagctcctcccagtagattcctgaacccaattatcaggaaatcatcctgagcactcacaggttcatttaacactcactcatcaagcaccttcctatgtgctaggtgctggggaaaacttgaccaaggaagagttcctgtcctgaagcttccaggacccagctttccttttctggtgtggccttgtagctagtgcctgggcacaggtgtttttctttttgcagttttacctagtgctgggagttcagttctttttcctctagaaaaatacctctgtgctccagagcctaatttttcccagatgcatatttagctctagggagaggactaggaggaaatccccctccctttagctgcctgaactgactgaggcccactcactagagccatgttcagtgctactgtgattagtagtaattaaatatgaactggtattctca

SEQ ID NO: 8063 - DNA, 1171 bp, Homo sapiens
cgcgagggccactacattcactgggaccacgtcatggtgccgcactgggaccccaagatctcggccagctacccccgcggccgccacagccccccagacgacttgggctccagcttctacccggagctggggccctacagctcccgggaccccgaagtgctgcgggagcatatgacccagctcaaggaagccgccatcggcgtcctggtcctgtcctggtacccacctggcatggctgatgataacggggagccctcagatgacctggtgcccgccattctggacaccgcccatcagtacagcatccaggtggccttccacatccaaccctacaagggccgggatgacatcactgtacatgacaacatcaagtacatcattgacacgtatggctcccatggtgcattttaccgctataagaacagcatgggcaagagcctcccactcttttatatctacgactcatacctgacgtcccctgaggcctgggcccacctcctgacaccaaacgggccccattcgatccgcaacacgccctacgatggggtcttcatagcgctgctggtggaggagggccacacccacgatatcctggccgccggatttgacggcatgtacacctactttgcctccaatggtttctcctttggttcttcccatcagaactggaaagctgtgaagaacttttgtgatgccaacaacctcatgttcatccccagtgtggggcctggctacatagacaccagcattcggccctggaacaaccacaatacgcgcaacagggtcaatggcaagtactatgagacggccctgcaggcggccctgacagtgaggcccgagatcgtttccattacctccttcaatgagtggcacgagggcacccagattgagaaggccattcccaagaagacacccacccgcctgtatttggactacctgcctcaccagcccagcctgtacctggagctgacacgccgctgggcggagcacttcatcaaagagaaggagcagtggctcatgtgaggggcctgtaaatgggcgtgaggtgctgatgtccttgccttgctggaagatgtcaccatgtggggttcagctgaggttgtagccatcactagagccatgttcagtgctactgtgattagtagtaattaaatatgaactggtattctca

SEQ ID NO: 8064 - DNA, 459 bp, Homo sapiens
aaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtgagtctccaagaagaggccacgtgctctctgccctattctggagagttgctctcctccgcccacagggttagtgcctctacagaagttcttggcagtagcccaaagggataacaaatatgtggcaagtgtggttttgggggagggttcagataaatggtgcctatgttgctcttagttttttgaattctaagaaaactgagaaaactaaatataggaccaagagaagactaaataattatcacttttgttaaataataatagaggttaggttgtaaaccctggtg

SEQ ID NO: 8065 - DNA, 589 bp, Homo sapiens
tcaggcgtcctggtcctgtcctggtacccacctggcatggctgatgataacggggagccctcagatgacctggtgcccgccattctggacaccgcccatcagtacagcatccaggtgagtctccaagaagaggccacgtgctctctgccctattctggagagttgctctcctccgcccacagggttagtgcctctacagaagttcttggcagtagcccaaagggataacaaatatgtggcaagtgtggttttgggggagggttcagataaatggtgcctatgttgctcttagttttttgaattctaagaaaactgagaaaactaaatataggaccaagagaagactaaataattatcacttttgttaaataataatagaggttaggttgtaaaccctggtggaaaaagggtaggcaagagccaaagggacctgcagactcaactctctagtgggaggcagtgctggacctcgaggagtaggcaggtgttctcagcaggtgggctcactttcaagaggaaggacggactggacgaagcatttccccacatgtgccaatcaagtaagtcatcccttgcttctgtggtgaag

SEQ ID NO: 8066 - DNA, 1102 bp, Homo sapiens
tgaattttgacgatccactgaatgttgaagctgcagaacatcatttgtaggacaaggaggacttcttgaataaagtcgatgactacatcaagtgttaatgccagatgataaaaggagaagattgcaggcccatggactgtgtgttacagtttgtctctaatgtgaaaaagcagcaagaggcattgccttctctcccctgtcccctgactctccctctcattcccctggattgtcccagtcctgtgaccatgttgtcctgacgaagaccatcttcatgactgcccgttgtagatggagaattcaacataaagacagcaagaaaacgtatttaggtttctaaagagttatctgcttgtcttatgttttaggctgttcttgcattgctataaatgcccaagactgggtgatttataaagaaaagaggtttaattggcttatggtttggcaggctgtagaagcatggcactggcatctacttggcttctggggaggcctcagggagcttttactcatggtggaaggtgaagcaggagcaggcacatcatatggcgagagtggaaacgagagcgcaagggggacagccagatctcacgagaacttactgttgtgttgaaagcaccatgtcgtgagggatccaccccgatgacccaaatacctcccaccaggcctcacctccaacactggggattacatctcaacatgatatttggaagagacatctaaactatatcaccttaacatgtttacttttttgaactcgtactgtttaggctgttggtgatactcttgagaagttgtaatgaactcaaaattgaggctggagctttcttattcttttccccaacaaaattggttttctcccgaagtgatgctcatgatgtgttcagtgtaacttgcagattggaataagaaacctgctacaaattgtgattggatacaaatgcccttatcctctgtgaatgttggccctatctacatgttgtgaagtttcccagaatgcataaagtctttcactgtagacatttttattgaaatgcatattttatttaagtatattttggaccaattaaattaaatttttacaatgtaatgctttattttt

SEQ ID NO: 8067 - DNA, 887 bp, Homo sapiens
tttgagatgtcgtctgaagttgtaagcagaaataatgtagctgctgaaggaataatgcctgggggtggagatctggtgagcttttagtgagcattaggcaatggaaggttctaaaaggccagcagaattctttgaaaagttcatttaaagccctttgtcccaaggctgtaggctgcagagttcttccaggtccacctcctccactttgtgacatttcagcttgcgaggaattaaattgtcgttaaaacacatttcagttctaggcatgagttcaaggtagcctggcgttcctctcgcccctggccatgagaactttgaaagggctttggcagcactggttggcctggcatgaggagctcatagcttgaggctcatgccccacctgtccataatgttcttattttcccatcatgagcatggacttgggtttgttacatgtccgataccattatggtcagtactatgcagatgacgaagcagccctgtcccccgtctgactcccatggctgcttcaagggcagtgtggttatttgctgggcagtggcatggggcttgtgcatttctactgtcactacagagggtttaaaaaaaagacatgggcaggttaagtggaagggaacagtctcacaccactacctttattgcttcttggtacttgggttttcaggaaattcctatcagcagacatcaaaaacagagaatgaagggacgcagttggcatgtgcctgtggtcccagctacttgggaggctgaggtgggagcatcgcttgagcccaggaggtgaaggctgcagtgagtatgatcacgccactgcactccagcctgggtaacagcgcaaccctgtgtgtaaaaataataattttttaaaaagattaaaaccaaaaaaa

SEQ ID NO: 8068 - DNA, 1244 bp, Homo sapiens
gcgagctcggtacccacaccacctgagtcactggattacaggggtgtgctaccatgcctggccaatttttgtatttttagtagagatggggttttgccatgttgcccaggctggtcttgaactcctgacctcaagcgatctgcctgccttggcctcccagagtgctgggattacagatgtgagccaccccacccagctgattttaaaaaacaattttaaaaaaacgtttgaaacagcccaaatttacataaaagttgtaagtacagtagaaagaattttttccctgaaccatttgagggttaagttgccgacctaatgccccatcaccctgaatgcttggtgtgcatttcctataaacaaggacattttcctacctagtcacaatacaaccatcaaaatcaggaaattaacattgatataaaacctctatataaaccttggaccccattaaagttttgccagttgtcctaggaatgttctttgcagcaaagtgatccagttcagaatcgtgggttgcatttggttatcaagtctctagtctcctttagactttcctcagtaaacgttccttggcattcatgaccttgatacttttgaagattacaggctggttatgtttagattgtctctcaattagggtttgtgtgacattttctcatgattagatttaggttgtgtagcttcaggaatataacagaaatgatgctttgttcttctcgtcgtgtgattttgatttatcccattattgataatgttcactttgatcacttgattaaggtgatgtctgccaggcttctccatcataaaattactactagttgtaattaataagtattttgtggggtgatactttgaaactatgtaaatatctcacatcaaagtttaattttattgatttatatctttatggactcatggttttctattcagtgcattataatccattactatcattgtttcttggccagtgggtggcttctgtatccttttggtatgttcccatcattatttgggtgtttccttgctttctgatacaagatgttatgcgctcatcttgtatttctcttgctgcatccctggaatcagccatttctctaaggacctctgtttcttttagtggggaatggtatttagaaggcaactggggctgggtgctgtggcccatgcctgtaatcccagcactttgggatgccaaggtgggaagaacatttgagcctaggaatttaagaccagcctgggcaacg

SEQ ID NO: 8069 - DNA, 394 bp, Homo sapiens
caaaaaaccttgttatgggtttttgaatcaaaacaaaccataaatttgatcagtaggtgttaggaccaatttaaaaccttcattttgcgtgaaatcattttcttaaaactgtttatttgccgggcacagtggctcatgcctgtaatcccagcactttgagagtccaaggcaggtggatcatgaggtcaggagatcaagactatcctggctaacatggtgaaaccctgtctctactaaaaatagaaaaatcagctgggtgtgatggcacacgcctgtaatcccagctactcgggaggctgaggcaggagaatcccttgagctggggaggcagaggttgcagtgagccaagatcacaccactgcactccagcctgggtgacagagtgagactctgt

SEQ ID NO: 8070 - DNA, 290 bp, Homo sapiens
catggctcaccactgcctcgacctcctgggcccaagcaatgattctcctatctcagccctctgagtagctgggaccacaggcctgtgccaccactcctgactaatttttctgtactttttgtagagatggggttttgccatgttgcccaggctagtcttgaactcttgggttcaagccatctgcctgcctggtcttcccaaagagctgggatgacaggtgtgagccaccacacctgtcttgttgaattttctataaacagtcatacaatttgcaaaagaaaacaaaaact

SEQ ID NO: 8071 - DNA, 385 bp, Homo sapiens
tgatgtactttgcagtcaattacagttaattaaattcctttcccattacttgagttttgggtatggagtggcaggtagtttgatccttgtttcattggtggaaaagctgagaaattctttgctccaggccacacagaagggagctgcaggccaggactgagtccaggcttctatctttattgcacattgcctggttgtttggttccactgtcaagaaattcaggacccaggaggcctgcagaacttgctgttgtatcttcctgtctttctcttgtttggatttcttcattcgagtgagagtcaacagggaacccttgccataaaggaactcagtattcatgtttggaaggccatattagactgtgctcttctgctgtctttactt

SEQ ID NO: 8072 - DNA, 297 bp, Homo sapiens
gtagagatagggtctcactatattgcccaggctggtcttgaactcctggcctcaagccaactcccacctcagccttccaaagtgttgggattacaaaatattacaggagtgatcgactgcactgggctaaaaacaagggttttaaatgcttaccatatttttaatgctacatctgattgtgaaggtgggctactcaaagctttttgggaatttacaggctcactaaaatgatcacgatagtgtattaaattgagaaaggcattgaaaatctgtcattcccatgaacaaccaaagggt

SEQ ID NO: 8073 - DNA, 459 bp, Homo sapiens
aagtttgactcctttgaactttaatgtcccaggattgtagtgctggagcaggattagacccaggcaacagcattccagttggctaattctgaagccagttggcagggagcataaaagtaggagggccttgtgccagctgctaagcatacaaggtgtgtatgtgtgtgcgcgccagctaactaagcatacggggtgtgtgtgtgtgtgtgtgtgtgtgtgtctgtgtgtgtgtgtgttggaaggaaagcatcgggaagtaatccaaactagaagggctatggtcatctaccctgtgttgattatggaagtcctttgctttcatgtcacttgcaaatttgaagtgggctggagtggaggtgggggggttgcagttggggcaattctgtctccactctaaaatcagctgggattgtactcagtagaatccttggacacaataaagcaaatagagtattagcc

SEQ ID NO: 8074 - DNA, 501 bp, Homo sapiens
ggctaatccaggacactctcccttcccatctgagatgtggtggagacaggagggtgatagagtgtctctatattaaacacacacacacacacacacacacacacacacacacaaaggcagccagactatgcactaggaactgccctgggaatcccgttgtgttctcataacaatcccatttcacagatgaagaaaccaaggcacagaaatattcagtaacgtgtccaggtgcggtggctcacgcctgtaatcccagtacttcgggaggctgaggcaggcagatcacgaggtcaggagttcgagaccatcctggccaacatggtgaaaccccgtctctactaaaaatacaaaaattagctgggcgtggtgacaggtgcctgtaattctagctactcaggaagctgaggcagaattgcttgaacccgggaggcggaggttgcagtgagcggagatcacaccactgcactccagcctgggtgacagagcaaaactctgtctgag

SEQ ID NO: 8075 - DNA, 374 bp, Homo sapiens
aaaaagtctaagattttaatattttatcattctaagattcttgggggtatctgaattctacggggctttaggagtccctgactcccctaacattctgggaagttaatttttttttgtcttttttttttcttcctttttgtggagaacggggtctcgctatgttgcccaggcaggtctcgaactcctgggctcaagctatcctcccgcctctgcctccctgagagctgggattacaggcgtgaccgccgcgcccggcaagtttctttaattttgtatttggccaaagaccaaaggcaaatccgcccggctgggaggaacgcggtcaggctctggccccagacttcgcgcgaaggcagcttccgcaagcttctccc

SEQ ID NO: 8076 - DNA, 496 bp, Homo sapiens
gtaagactttgtctcaaaacaaacaacaaagaaacaaacaattgcatggagtaggtactgtcagatgctttaagtaataaaggtccttttctgaaaaggagtacacttaccagtattctaaacttaatgaatgcacattttaaaatataaatttatggtgagggaaagcaacctccccttctgactagacttaaaaattctggccgggtgtggtggctcacccctgtaattccagcactttgggagacctagctgggctgatcacttgaggtcaggagttccagggcagcctggctaacatggtgaaaccccatttctactaaatatacaaaaattagccaggcctggtggtgggcgcctgtaatcctagctacttaggaagctgaggcaggagaatcacttgaacctgggaggtggaggttgcagtgagccgagatcttgccactccactcccacctgggtgacagagcaagaccctgtctcaaagaaaaaagaa

SEQ ID NO: 8077 - DNA, 428 bp, Homo sapiens
ttatgagtttgggtttgggaggtacagggcctgggctgattcctgcccctcctgctcaccagctctctgagcctcagtttcctcatctgcgaaatggggcaataatatgtctcatgggaacgctaaggactggatgcttatgaagcattgatcacaggggctggtccatggtgaatgtcagaacatttcatcaatgttcccgttattgatcagtggggagagaatgaactgctcccactggcttttcactgggcgttcaagcctgctgggcttatcccaactccagcttccagacatgagcatagaactcagcctgtattctaggtttgtctggacaaatacccaaaagatgacctctgggttcattataacctggcccatcagctgacactctcagaagccaaggacctggagaagaggtaattgac

SEQ ID NO: 8078 - DNA, 512 bp, Homo sapiens
aacagctcattctgttattgagcttatgtgaatgttttgtttcaggtaatttttttttcagttctaacattttgttttctttcttctttttgtagcagctttctttttttgcagcagcttctgtttctttgctgagagctgtcatttcattcacttcaaatatgtttacctttacttcatacaacatagttagaaatgcttttaaaagttttaaaaaataatgcattcaacatctgggttatttctaggttgacatctgttgactgtcttttctcttatttggtcacattttttggactctttatgacaaataattttggactatatcttaaacatcccaaatgttatattgtgtaggctctgcatcctgttataatcctctggagactattgggattttttgtttatttttttgtttggtcaggcaatcaattttgcttaggttcagattccaaatttctgttttgccttctgtgggcagtggttctaatctcagttcagttttcaaagct

SEQ ID NO: 8079 - DNA, 335 bp, Homo sapiens
gtaggcaggccatagtacaacagtccttgggtgatgccaattctgtgctgatctggcaggctgggggatttgggtgtggccctgcatgagatcagctgcagcagctatgcagagcccatgtcactcttttcccagctccaggcagtgcggtgtgaagagactccttccacttaggagaggaaagtatgcaggggactttgccttggaacctagtaccagctctgccattgtaaactagagtaccagaagagccttgtggaccctgattccaggcagatactcctgaacagtacttctagacccaacccaggcaagaagggaatcagctgccttgg

SEQ ID NO: 8080 - DNA, 300 bp, Homo sapiens
aaactaaatttgacttgcagatgtgttttgaatgacaggcaaattcattttaaaataggtgattcgatatttaaaaagaccagaaaacgtaggaacactggacccatgttcctgtgtgggaacaaatggccacattgaatgaactcttacttctttaggtagggcaggtgctttctggtcggtcatggtccctaccactccctcgtgttttgcctgctgagacttcacctacttactcctgtgtgtcgcctgcttggtccttagggacttgtatttgtgattcctgctttagaaaggtgg

SEQ ID NO: 8081 - DNA, 388 bp, Homo sapiens
gctggaaaaaaacaggttatgtaacttccccaagaataaaagaaaaaaactcaatcatcagtaaccaagcttttaccaacggacctgtggcacacatgtgtgtttatggggtgtgtgtgtgtgtgtgtgtgtgtgtgtgtgtaaaatctcacatccattgcagtgatattacacaaaagttttaaattatatttctacttgcaactctcctttagggtttaaaattaatcattctctttaaagtttttaaaaaattgattacagaataactgctaattatctgtttctagacactgctcacacaggtttccatttttaaaactttttatgtattttttttttaaagacagagtctggctctgtcatccaggctagagtgcaatggtgc

SEQ ID NO: 8082 - DNA, 428 bp, Homo sapiens
gtcagttgagtgcattcagtgtaaggaacagaatgaaaaaagaatggagaaaagtgaatagagacttacagagctgtggcacaacattaaggacaacatttatgtaatgaaaaaccatagaggagaaaaagaaactgggcagaaaaaaaatgtgaataaataatagtcaaactctttttaagttggatagaaaacattaataaatttatccaagaagctccacaaatctcaagtaagatgaaaaaaaaaaagaaatctacaaagagacacatcctagtcaaatggtcgaatgccaaaggcatggagaatcttgaaaacaccaagagagaagtgactcatgtttaagggatcctcagtaaaattaacagctgctttctcatcggaaatgatgtggccagaggcaatgggatgacatacttaaggtactg

SEQ ID NO: 8083 - DNA, 368 bp, Homo sapiens
tagtagagacagggtttcaccatgtttgtcaagctggctcctgacccccgttgatccttttgactgagacttccaaagtgctgggattacaggtgtgagccaccacgttcggccgcttctctttttatgtgtaaaaattaggacagtaatacctgtttcgcagaataggtattgatattgaaatgacatttacgtgcaggcacatggtaaatactaaaattggtgctcctccacccccatgtaaagtttgttaggccaggcctggtggctcatgcctgtaattccaccactttggtaggcctaggtaagtggatctcttgagcccaggagtacaagaccaacttgggcaacatgtcaaaagcttgtct

SEQ ID NO: 8084 - DNA, 892 bp, Homo sapiens
gagggcttcagccctcttagtttgagacccctttccttggtcattgcacaccttcttcccctgatagaagaggcccagactgtctgtccctgtctcagggtcacctcagtgagggacgcgacctccaggtcccctctgagcctctgaacagcccagctttgctcctggagttccgacacataggagggttagaggaatccaaggaggagctttctccaagaattggtggtcagcattgggctacctggagagagtgactgccaagccccatggctgcactgtctgggttggatggggtggtcctgcactgggtgactcatgaccctgaaggtcccccatccacctccatgtcctgggatcccccagtccagacagccttagaggcaggccttcctgagtcaccaggactctataaaaaccacaaacccccagtgggcagacgcaaaccagccaagtgattcagagctagggaacctggggccaggaagcagggctgggagaaagtgagaggccggaacaactaaaaatccagggattggaaagacagacgctgagcacccccaggcagacggaaacagcaggtgctaaatgccactttgtgggccaggtgcggaggctcacacctgtaatcccagcattttgggaggctgaggcaggaggatcacttgagcctaggagtttgatacgagcccaggcaacatagtgagaccccatcaatacaaaaaatttaaaaattagccgggtgtgacagcgcgtgcctgtagtcccagctcttgggatggctgaggcaggaggattgcttgaacctgggagttcgaggctgcagtgagctgtgatcacactactgcattccaacctgggcaacagagcaagcgaccctgtcttaaaaaaa

SEQ ID NO: 8085 - DNA, 259 bp, Homo sapiens
ccttgggcaagttactttaaatctctgagcctcagtttcctcatctgtaagctctaaataataatacttaccttgttagaagttaaaaatacatagatataaaaaccttagcccagtgcttgacatataagccttcaatcaatgctagcaatttcaccattattattactgaataattgtgagaccttgagcaagtcacttaacctcatggtgtccttttctccatttcttgggggtggttttgtgagcattaagtaaa

SEQ ID NO: 8086 - DNA, 482 bp, Homo sapiens
tgagtgtttctattaataagtatctaagtttcaattgtcttgtatctttccctaattctccaaacggttcaatctccagttttattcagggactgggccattttgttctcagagggacaaaactgatctctccatgaaatcccctgcacctcactctgggcagctctaggctcagcagatgtttttctgccattaggaaacagccccttactctcagctcctgtgctaacacccatacccaccagctgggcgttgggacctctcccgtcatatggctgccacttgcttgggaaggaattctccagactccttttactttgtatgtgtttctagggggaattctgaggggaagaagctttgcaggcaacctctgtgcccaggaacatacggctcacaagtcctttgtgccgacagggaatctatctaattgttttagtgtgtgaggctcattgtcagcctagatttccctgaaactctgggcc

SEQ ID NO: 8087 - DNA, 400 bp, Homo sapiens
ggttataagaactggactctaaggaaccattagcttaacggagaatatggaaacagtcacgtgatctgctaacctctatgtatatagctgagtaacccacagttaataagcatgttactttttggctcttataattctgacatggagttgtacttgcagggaaatgggaatgagaatgtggtttgcattatggtcattatttattttatctgttattcaatattcttggggcttgcatatgatgatgtgttccaaatagccattgagaaaacaggatttaatcaaaattgctttggactttatttatttgtccaacttttaaaatatgattattaaataaaattacctagagttaatgggatttggatgacttactatttatgtaccagatgcaattctc

SEQ ID NO: 8088 - DNA, 472 bp, Homo sapiens
ttgacctttttgttgattttcagggttggatggaatggcaaccgtaaaggtcattctgtacagggtggagcttctcctggaagagtttgcccttaacttaggtgacaacatgtgttttctccaccagtgtctacgatgaaccacatcttcctgatcagaaaatatcactttaaaaaaaagactctggggcctggcgcagtggcttacccttgtaatcccagaactttgggaggccaaggtgggcaggtcacttgaggtcaggagtttgagaccagcctggccaacatggtgaaaccccctctctaccacaaaatacaaaaattagacaggcatggtggcacgcgcctgtagtctcagctactcgggaggctgaggtggatttgaattgcttgaacctgggaggcagaggttgcagtgagctgagatggtgccagtgcacttcagcctggggaacagagtgacacttgtctcc

SEQ ID NO: 8089 - DNA, 472 bp, Homo sapiens
actaaaacacttctaatacactaaccatcaatgtttcttgtatgttaggagtgaactgaaagaaaatcttccgcttttgctaaacaattgttaggaacaactaagacacttctaatatactaactatcaatgtttcttgtatattaggagtgaactgaaagaaaatcttcagcttttgcactttttaaaatcaagacacattttggaaatgcagagtagttttctggagcttaaggattggaccaaatggtcccccattgccactttttaacttcaattgccaatacactttctcctctctgtctcatctcaatctgtactactaaaaactcatattcaaaaagcaaaagaatgctcactcagatttttacaaatctatctacatgaggagagaaagttttaacttgcttgagggagtaatttgttgaaacgttattcttccagaaaaagtaaatcattgtgcttcatttca

SEQ ID NO: 8090 - DNA, 344 bp, Homo sapiens
tttttcttctggggaatgtttgaagtcccctttaaaaataatgccttgaggatatttttccctaataccatttaaagaaacttgaaagcatatggctcttgaagtgcacagggttctaatgaagtaatcagtgccctgctcatatgcagacttccacccagagctttcaaacccaacccagatcagtcttttgaatgaagtgaaattctacagaaactcctttcctctctctgccagtgtaaaggcttagtgagccactgtgcttaagtggtgactttcaacctttgaaggatggaaggtgctggaaaagttgtgttaggatcaaaactgtcagtggccaagca

SEQ ID NO: 8091 - DNA, 541 bp, Homo sapiens
agttgctcatcactaaatgggaagccttattaaatagaaatactggcttgtatttaaaatgtttattagtatatatatttgggcaaattttacagtcatagaatagacacagaagaatattaagttaatcagacatgatttagtgagatcaaaaatacaaataatctgaaaatttagtgaaaagttctaaatatactatccataccaagcacatcaatatattttagaaaataactgtattgaccaagctggctgaaaataagaattttgtttttctagagagcactaattgctacttaatgtcaaactaatgacatctcacccacccctcctaaaatcctactaaaataaaattatagatattgaaaaaggaaagaatctataatagcaaagaaaaagggccagagttttgctaagaaatgttctgtagttgggtgagctcaggagttcaagtgatggtcctgccacagcatcctcagtagctagagctataggcgtaaccagtctgggcaacataatgagacccccatctcttaaatta

SEQ ID NO: 8092 - DNA, 360 bp, Homo sapiens
ggtggggggttttggcgtgttctatagctgagctacaagcaaaattagagctttttacttatatactactttgcatggaggtagtctcagggtcccagttacagcactgatttcttgaaaagagtttgatgttctggcccatgcttaatttaaatgagaggctaaaagcagattgtgtaacccaccaatgcccatttgacaggacttgcaccaatctgacctacactttcataagagctcctaagcagagtgctgtactgtgggtcttctgccttaactccaggaatggcagagatgagctactgtttattgagcaccgacaaaggagaggtactctgagtgttgaatgcatgctgtctc

SEQ ID NO: 8093 - DNA, 563 bp, Homo sapiens
ccattccattcgtgttcattcgattccattccattccataccatttcattcaattcctccctgttccattgcgttccatttcattccattccattctagtcgggttgattccattccattccattccattccattctataccattccattccactccattccacacgggttgaatcctttccatcccatcccattccattccattccattccattcttttccattccattccttccactctggttgattccactctattccattccattccattcgaaaccattccattgcattccactcggtttgattccattccattccattccactccattcgattacaatccgttacattccattccattacactcggtttaataacgttccattacattcctttacattctactcggtttgattccagtcaattccattccattctgttccattccacacaatttgataacattccattccattccattccactccattccattccattccactcgggttgaatccaatccatttcattccattccattccattccattcctttccat

SEQ ID NO: 8094 - DNA, 836 bp, Homo sapiens
cgcaccgcacccggcctaaaagtaattacttttaatggcaaaaaaaaaaaaaaaaaagaaatgcaattaattttgcaccaacctaataactaatgcctgatgatctgaagtagaacagtttcatcccaaaaccatcccccaccacagcctgggtgcgtggaaaacttgtcttccatgaaacccatccttgggtccaaaaaggttggggactgctggtctagaggatacagtccacccctctctctagacctgcactatccaatatggtagccattagccatatgaaattttaatgttaattaattaaaataaaatattcagttcctcagttgcaccagccacatttccagggctcaacagccactcgtagctagtggccaccctattggacactgcacatagggaatgtttccattgcaaaaatttctattggatgctgctgctctagatcctcaaaaatcttgctagcgccaaaccatcagaaattcacccacatatttgtaccatcttatttgtatcatctgctggccctctgctgtggaaatgctcttggctcatattgagggatgttaaaagaaacagctcaggagctctttcacagccttatgcccccaccgcctgctccctgctctcaagatcagtagttcttttctggtttcttctcttacagacacaaggaatcttgtaatcgatccttttctctcttcactttggctgctagaaagctgagagccaaaatctaagactaaataggatttcatggcactcattttgtgaaccaccctcagatctgattccatctttattatcttacccttattttccctttgcctcat

SEQ ID NO: 8095 - DNA, 1671 bp, Homo sapiens
  misc_feature (1497)..(1497): n is a, c, g, or t
agtcaaggaggacagtgacatgcatgtgtaggggctggggaccaatctgtcttgggggtcccagagatggatctgctgtgacagagggggccaagaccccgttcagagtgggggagggggagaggagtcacaggttcaacatgaagaacagttttaggaagtgggagggctggggacctacggcccatgcagtgccagatgggaccccatgcaggtgggttgctggaggaggacagggaaacagactgcagttttcagggatgcccttggaccttctgactcagtggcccaactcctggctgctgccctcctcccccactcccaagacctccaggtctgagcagctgtcctgcggttgaggtggacctgttggggaagtccatcaggaacctgccagggcccgaaagagagtgctgggggctctgtggcaggaaatgagggaagtgtccccagccacctccccccttagaggtgtggagattctggtcagtgggagaagctttaaaagagcttgttctccaggccccaaagtagggcaggagaggaggagtggcttccaggcaagtggctagacccagtcacctcattgtgaccttgcactctccagggatgtggtcccctgggtggtgggagctatatacccacattgcagagagcaaaaccaaggaagacgaagcaaccactagctctggttcttcacctcccacccccatcccccaagaaagaacgggtgctggtgcgggccacagggtgctggcagctccggcatcactaagaccggcccccatgcccatgctggagagccattccctgttggctcatattggaaatgggcctgttacccgcagctgcccctctatgccttgggccaggatggacagcccccaggggtagggggatgatgaatgagtagcaactgaaggaaaggtgcctccgctctcatgaaacaagtgaaggatgagacagccggatccttggcactactgttctcagggtgaaaaaaaagcaagctggatcctcatgctgccccactccatatggagcccatccaaactcagaggtgtcagagggggcagaaagaggggactggcctttttagagagaagcaaccctggtcacttgggagcgtgtgcccagggagatggggtggggtggggtcactctttgtctgtgaggaggcaagggcatggctgcccacaccttgtcctactcctgagctgggccgtgtagcatgggcccatgcacctccacccacagtgcagtgttgtggcccctttgccaggctgtgagttgacgggcagcagactccccgggaggggtgaaatgcggagggcacagggcctgtgtgagacgcagggaaagctggagaggccaaaccaggggccccagcagtaggtcggaggtgaagtcgggccaggtgcagtggctcacacctgtaatcccacactttgggaagccaaggcaaggggatcacttgaagccaagagttcaagaccntcttgggcaatacagcaaaaccgtgtccaaaaattaaaagattagccaggtgtggtagcacgtgcctgtaatcccagctactcaggaggctgaggcaggaagatcccttgagcccaggtgttccaggctgcagtgggctatgattgtgccactacactccagcctggcatctca

SEQ ID NO: 8096 - DNA, 781 bp, Homo sapiens
gtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaacctctctgactccttctgcctacataggtac

SEQ ID NO: 8097 - DNA, 1119 bp, Homo sapiens
  misc_feature (1080)..(1080): n is a, c, g, or t
gtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaaaaaaaaaaaaaaaaaaaaaaaaaaaagaaagaaaaaaaaaagaaaaaggggggggggggataggagattcccggggggggcaaaatttaagggttaccagagttttgttgtaaaaagagggccccaataggagagagcgaattttacaacatagagaatggcagcgttttaacaacgcccgagccgcgaccaaaccgccccgccgggacccttctgaaaggacaccaacacgagcgcgggggcacaacatctggaacaaatatccagacagaagatacagcgccccagcgacactcacacgcgtcaccggctctcggctgccaccacgaccacnattctaccgcgtgaagacttgcccacagattcttggata

SEQ ID NO: 8098 - DNA, 715 bp, Homo sapiens
ggattttgtaaattattatttaatttctattaataagtgagctttaagaatgccgagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaacctctctgactccttctgcctacataggtac

SEQ ID NO: 8099 - DNA, 941 bp, Homo sapiens
  misc_feature (902)..(902): n is a, c, g, or t
gtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaaaaaaaaaaaaaaaaaaaaaaaaaaaagaaagaaaaaaaaaagaaaaaggggggggggggataggagattcccggggggggcaaaatttaagggttaccagagttttgttgtaaaaagagggccccaataggagagagcgaattttacaacatagagaatggcagcgttttaacaacgcccgagccgcgaccaaaccgccccgccgggacccttctgaaaggacaccaacacgagcgcgggggcacaacatctggaacaaatatccagacagaagatacagcgccccagcgacactcacacgcgtcaccggctctcggctgccaccacgaccacnattctaccgcgtgaagacttgcccacagattcttggata

SEQ ID NO: 8100 - DNA, 645 bp, Homo sapiens
gtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaacctctctgactccttctgcctacataggtac

SEQ ID NO: 8101 - DNA, 474 bp, Homo sapiens
gtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttacctcagttgagagtgagcggggtacagtaaggcagtgcttcccacactggacctctttcctggttctcttttgcaatacattaacagaccctttatcaacataaacaatagtaactgagctattaaaggcaacctctctgactccttctgcctacataggtac

SEQ ID NO: 8102 - DNA, 812 bp, Homo sapiens
ccgtcctctctcaggccctgtccgcctattcccctcatcctggccatccagggaggaggagacgccagctgcttctcatttcagtgtccttaaaatccctgctggtctgggctcacacagtgcgacattgcatttccaccacaccaactgtctcccatctcctcagagtcagacccagggacttgcaggaagctgcaggcagcatcagagtcaccacttccctggggtcaaagccgctggccaggcttccacagagagcagaggcctcggccactacttaggcttctgtggctcacctggtgtcctgttttctcttaacagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatc

SEQ ID NO: 8103 - DNA, 435 bp, Homo sapiens
cactccagcctgggtgacaagagtgaaactccatctcaaaaaaaaaaaaaaaaaaaaactagttccttctgattttgtaaaacagctttatgcatgtggtacattttgccacttatcagagatgtatactgtcatttagagccccttgggtgtaattagcaagggcttccatgtgccagatgacatcatccagacccagggatggaggaacatagaagctaggtgattgtaccagcgaaaaatgtacttggttcatcttttaaccatgtgaggaagattagcgtgttattctgtagtctttgtccagtgtccctgagcccaggagaggcccactgtacagtgtcctggccatcctgatgatagccaggtttataccacaaaaccactgaattccattagaagcataccagttaatgccaggtcactgggatcagt

SEQ ID NO: 8104 - DNA, 407 bp, Homo sapiens
gctttagtgaagagccaccacactcttgttagtaaaataattttaagcctctataacgctcacttgatgttactaaaagggtagaatatagaaaaaaggccaagtctctggatttgaaatttcttagtgtgggccagtaatctgcatttcagcaaatccccttgtgattgtgatatgtcctaaagtttaaagaactgctgtgtacctccttaatgtatttaatcttcaatataaatgaccattcatcaaagaggcttgagcaaaggcatgacacaatcaaacctatggcttccatgttaaaaatagtctcttggagcaagggtgaaaacaaagagaccagtttggaagctactgcaataatcaatgtgggaaatgatggtagactggacaaaaaaaaaaaaggcagc

SEQ ID NO: 8105 - DNA, 503 bp, Homo sapiens
ccaagggacaaagctcatcaatgatgttccactgttctctggggctctggctctaagacctccactgggtcgggtttctggagaagaggcccattctccaaagacccttcagggtcaccacccctttggtcagggtgtggcctcatagcttcttttgaactggaacacatgactgatggctttagagcatacaaaaaataagtttgcgaaaaatatcttaataataatagaaagaaaggaagaagaaacactcctttatgtctctaagaatagatgtgaaacatgtgtgccttggaacaccttctccctctcttgccccacgtgagctggagcttacatgcctgcttgttttcagtactgccgtaaccctgatggtgacatcaatggtccctggtgctacagagtgaatccaagaaaactttttgactactgtgatatccctctctgtggtaagttgccttctgttttggtaaggaaactgcttccttcatatggatttgcaa

SEQ ID NO: 8106 - DNA, 454 bp, Homo sapiens
agatcacctgaggtcaggagtgatctgacctaatcctaaaatcctaatctcagtgagtgctgactgccatccatccagatcagtggaagggtgagtttgatctcttaggggagacaaagctatagaggccaggtctgcctcacttgccgaaccaactcgtcgtttatccagcctgtatctgcaggtgggttggaggggctgctcagtgctgggttaaaagtgtgaattctagagactgtcagccagacctgggttgaaatactggctcccctccttataagctgtgtaaactgggcaaatcacctcatcactttgggcctcagtttcccatctccaaaatctgtaatatggggagactagtaaatacattctagggccattaggagacttaatgagaaagttgacaaaaaacctcttagttttgcagtggcaagcccataacagcagctcaaaa

SEQ ID NO: 8107 - DNA, 510 bp, Homo sapiens
actgatgaaatggacagacatactcagcaagaacttagagtgaacttatatttctaacagtaatggagtggacagtcataagacattcatacagtaaaactattttctagaaataatgaaatagagaaatgttcctaatgaagtataagatgtaaaactgtatatggaatatactgtacatcaaggaaagactgcaaggagataaatattcaagtgcttactctgaatgttagacttataggtgattttttaattttttaatgctttttcatgttatctcagcttcctagttttgatcttataatcaaagaaaaaaacatatctttgctccttctgttatggccactaaaagaatatgaagaaagctgcgtgtggtgttgcatgcctgtagtcccagctatttgggagactgaggcaagaggattgcttgagcccaggaattctaatccagcttgggtaatataacaagacactgtctctaaaaaaaaagttaaataattaaaaattaaa

SEQ ID NO: 8108 - DNA, 342 bp, Homo sapiens
gcaaggaggaactacagaacactgaattttcctttggctgtttcctggtgtatcccagaagtaagaatggttgttgagaggaaccacgaaagtaatagaaaaagtatgctgacataaaaggggttaagaatgacctccaattgaggctgggcgcggtggctcctgcctgtaatcccaggactttgggaggccaaggggggcggatcacctgaggtcagttagagaccagtctggctgacatggcgaaaccctgtctctaccaaaaatacaaaaaaattagtcaggcatggtggtgggcacctgtaatcccagctacttgggaggctgaagcaggagaatcac

SEQ ID NO: 8109 - DNA, 656 bp, Homo sapiens
caggtcttttagacaggtcagcagctttactgtggtctccatttctgacaaagtcagataggaatcaccgttgtcccctctgtaattgttgtcccctctgtaattttcccctctgtaatctcctaagctatgttacctgcctcgtcttccctccctcgccacgtacgtgtgtgggtagacacacaggcccacacatctgccatccctgattcccgcttttctctgatctgcagtattaccgggcccttgtaaatgctttgccccagcaccattgcttccattgtgaggcgtccagacgagcatggcacccatccccttcttgtccagccacccctgcagctctgtttggaacacctcctccttttccatgctgtgtcggctctgcttgtctcctcttgctctttttattgtggcactgtttagtagtcatcttttgttcttttgaggggcatttattgagcaactggcttgtgcagagcatagggagggagatgtaccaaaaggagacggacacgcacctgggagtcctggttcaaatctgtgagctcctccctgtgaggggtgccccgttaaccttgatgagactcagctactgactttttaaatcaagagtgtccaatcttttggcttccctgggccacactggaagagttgtc

SEQ ID NO: 8110 - DNA, 482 bp, Homo sapiens
ctataactaagactgtttgttggtctctgcatatactttcaggtcattaaatgctacagaaatgagaaatgaaatacaaactttttaactcctactcagatgtccaaacagcttcttagttcctgtcagatcagtaataatactgggtttggtctttcttaaaccaagcataatcctgcttatcttagaatgaaacagtattcctattcagaggtaaatagagttaacctttactcgtgtaatttttattgtttgttttaccatttcatggtgttcatactagccccttttcctttccctctaagtgactgctgaggttctcaccatttcagaataaaattcttgtcctttgaggttggaaatttaatgataattgaaaaactgtatgtgtcagtatacttaaaaggaaaggttatatcattctcttcattttggatgtaaaatttacctgttagagaaaatttggaaattatagaaaagta

SEQ ID NO: 8111 - DNA, 413 bp, Homo sapiens
aaaacataggcggaagctccaggacattggtctgggtggtgattatttggatatgaccccaaaagcacaagcaacaaaagcaaaaatatatcagtgggattacattaaactaaaaagcttctgcacggcaaaggaaacaatcaatagggtacagagataactggccgggcacggtggcttacgcctgtaatctcagcactttgggaggctgaggcagatagatcacgaggtcaggagtttgagaccagcctggccaatctggtgaaacactgtctctactaaaaaatacaaaaaattagccgggcacgtggtggcgcatgcctgtagtcccagctactcaggaggctttgacaggagaatcgcttgaacccgggcagtggaggttgcagtgagctgagatagcaccatggcac

SEQ ID NO: 8112 - DNA, 447 bp, Homo sapiens
catgcggtatttgtctttctctgcctggcttatttccctttaagatgttcatgtaggttcatccgtattgttgcaaatggcagaatttccttctttcctaaggctgcatagttctccactgtgtgtgcaccgcattttctctatccactcatccatcggtgcgcgctcaggctgattccacagctgtgcttttggggaatggcgctgtggtgaacgcgggctgcagatgtctcgtcggcagatgagttcatttcctgtcagttatacccggtaatggggtggctggatcgcagggtagttctatttttaatctttgggaggaatctctggcactgccttccacaatgggctacactaattgctgagtgtgtttaggagtctgggcatgcactccttttggctaggctctatttgctggcattacataaactaaaattagcagctgga

SEQ ID NO: 8113 - DNA, 559 bp, Homo sapiens
ctatttgccacttttctttaagtttccagacttggtagcataaagttgttaagataatattctcttagccattgtgtgttacaaatatagtgcaacctactctttcattgcttttgtttgagcaatctagttttaaaaattgtttttaataatttatttaaaataacatttgtttgtttactttatcattagtttgttttttccttcagagatgtcttttctatttatttatccattttttacttttacttaataatcaagctcctctttccctagcttcttttggtgggagctgaaatcattaattttttaattcttttttcttcttttttaatataagcatttgcagttgtaatttttcatcaagtcactcctttacttttacttcacaaaacaagaatcagaaccatacctaggtacaacacaactgttaggatcatcattcagagaaattaaaataattgtgattactatattaagggctcttaacagaaaaaaaaataggggtgtgtaatataaacagagaaatgaaaaaagaaaaaaaaactaagaaaaaaac

SEQ ID NO: 8114 - DNA, 957 bp, Homo sapiens
aaaaaacctaccgattaaactgtgacacaccattgattgtaagacacaccctgattggtgaggtgtaaaaatgggggaaagtggctctcttagaatgaaatatcttagaatgaatttgtgtgagtcaggggcaggtgaaagtcattttgcaggattctaatggcttctccatacacctctctccgaagaaagaaaggacttggggtgttttgctgactcctggcagcattcttggcccaatgtattctgggtttgctcttccccgttggagagccctttgccagagaacagccgctggcttgttgagccaggaagcttaccatgtgagtgcagcttgtgtctgaagaggctgggccagtacagataatacgaatcacatttcactggctttttgatcggctgtttagctcctggcagcttgttcccagcattcatgtttgctgtgagtaggaaacacaaagaacctcgtcttcagaacgagaaagacttggggctggattctagctgtgcccgtggctggcttagtgctcatgattgtggccctgtgcagaccactttgcctccctcagtctcagtttccccacctatcaaaacggatattcattcctgccttgaatgtgttatgtaatgattaaggaaaataaaatgcaagtgttgaagttgatacaggatctttatttcattccagaaaactctgtaaagtttcctcatttaaaaattccttccttctgtggccgggtgtggtggctcacactgtgatcccagcactttgggaggccgaggcaggtggatcacttaaggtcaggagttcaagaccagcctggccaacatagtaaaaccctgtctctacaaaaaatacaaaaattagtcggacatactgtcttgaacccaggaggcagaggtttcagtgagctgagattgtgccgctgcactccagcctaggcaacagagcgagac

SEQ ID NO: 8115 - DNA, 394 bp, Homo sapiens
gaccttcatgagtgtgtgcacacatattcgatgaggatgcttgtatcttggggaggtcctatgaccctgtgatacacgtgtgtgcatacactcatgtccctaccgctggacatggactctgtgtgcccaatgagtgtctgcttgaggccctgcctagccacagacagccttggagagcccacgctcagatggccactccagacctggcaagatgaaaattttaaattggagatagggtgttctggggtggaagtagggttattgaaaaccgcttaggctgggtccagtggctcaagccatctcaaatctgtaaactcagcacattgggaagactcaatgggagttcaaggagttcaaggtcagactggacaacatagcaagactctatctctac

SEQ ID NO: 8116 - DNA, 262 bp, Homo sapiens
gacatacttttaagagttgtatttgtcatatatagaccatgtgtcaggtattgagctaggtacaaggagtacaataaataacacaacacaatgtatgccccaaaaggattttatcagcatcagaagacatatgataacattccaagataaaaagatatagaataaaagagttatagaaatttattaaagatggagtcatggctgagggcctctgaaaaacacaagcgtaatttgaagttagctttgaaatatttaataaagg

SEQ ID NO: 8117 - DNA, 699 bp, Homo sapiens
taacattcgaagattttattttgctgctgtggtggagaatggctgttgaaggtcattaggagctagttaatacaggtcatatttcttgggagagctgatggagattggcctggtgattcctgaagaagtgacaagaagtggacaggtttgagacactaattacagttctagacaccgagtccctcctctgggaccacactcctttacagacctcatctctttaggatgggcagcatcccttcagggctgggactgcttctgccacacctcccagacacataagccgggcctccaagaaggctgtgtcttttgctgaacattccacaggttgtaagagacagagggcagcattcagcttcaggccccctagaccccaagtcctgcatcgtcccagtgtcacaaggcctccagcaatgatggaggacggaggggggctttcctgccgctttccaaagaccaagcctcgaagactttcaagctggacacattccccagggttgcctgaccgccttcctgggaggggaatgctggcagccgagcctgtcaccacccacagaactattgtggtgcctgttacccacaggaaatgagacacaccgcaggccgatccctgcatgatctttgtctcacagtgacgtcctcgttagtcaggtccttttttcctccttctccatcatgctacttgagttctaactgaga

SEQ ID NO: 8118 - DNA, 655 bp, Homo sapiens
tgtccctgctgagaggttccctgtgccagggcagtccaaaaaagttgtccctggggctcctgcccaccccagaatccttttccaaacatgactcatatgtgcaggtggtgaaaggggacacttcggtgatgtctacatttctctccttcctggaagagaggcccctggggaagtcacaggtttgggagagatctggtctactggcaagatactgctttcagagatgcagatgccacctgggtaatgcccatgtctgcagtgcaactgactggtggcaaggggtccaggaagagaatatcaatttaaagcaacgggaaggaggagataaactgacatgcaccagggagctacggtcaggggtttatgtttcagagagagcaaaattgtatcagtgttcacaggccaggctccagactatctgtccagtagaaacttccatgatgatgaaaatgttctacatatgaatgtcctgttcagtagcctctagccacctatgatattaagccctaggaatgtggttcatgaaactgaggaactaattggtttaattttaattcgttaaatttaaatagcctatttgtgggcattgggttcccctactggacagagcaggtctagagtacttcacatgccagggctgctacttgcattgaga

SEQ ID NO: 8119 - DNA, 464 bp, Homo sapiens
ttacagattatatttaatgccagcaaacagcacaacatccctttcaataacagtgagagtaatagtcacaaggtcttagcatgtatagagtgcttaaaatgtgccagacgctgatctaagttttcatgtctgaaataatttttctttacactatgcgtatacgatataatgtttttgaaagcttggctgggtgccgtggcttactctgggaggctgaggtgggaaaatcacttaaagtcaggtgtcccagaccagccaaggcaacatagagagacccctatttctccaaaaaaaaaaacataaaataaaaatattaggtatgatagtgcatgcctgtggttctagctacttggggggctgaggcaggaggatcacttgggttaaggagtttgaggctgcagtgagttgtgattgcaccactgcactctagcctgggtgagagagggagagagagaccccatctc

SEQ ID NO: 8120 - DNA, 547 bp, Homo sapiens
gtgctccaggctccagcctacctggctagaaccaactttcactgttgtccccaaacctgctacatccctcgaaccccagggcccagttccttacctcaggggctttcagaccaaagacatggatatcatcctctacaccctcatgccagccataacatcctacccagcactgtgtctaggattttgcctcccaagcatttttagacccatttcagggcagctgaaggaatctctcattcctttgcttcaactcttccagggccctcaggatggagtccctggtcctcctcctaacatttaaagtctccctgacctcagggccctcaggatggagttcctggtcctctgcctagcgttttaaagcctctctgacctcggggccctcaggatggagtccctggtcctcccactagcatttaaagcctctctgacctcgggctgctgactactttgtctcacctcctctgctacagcagacagtccagtccagcatcctctgagctagtccaccttttcatagccctcagacctctgaagctcaaaatgc

SEQ ID NO: 8121 - DNA, 368 bp, Homo sapiens
atgtttacccatttttaggtcctgactttcatacaaagaagataatcctacaacttctaaccttccatttttacatcctatttacatttttgagatgaatggtgataataaagatattaacaaccaccaaaacaaccaacacttatttagtatttagcatgtatcaggtgttgtcctccaaaccattgctttatttttctacttccccttgatctccatccattgagctccagaagatgagactatctaagtatgaaacttattttggggccgggcgcggtggctcacgcctgtaatccgagctctcagggaggcaagaggcgggaggatagcttgagcccaggagttcgagactgcctgggcaatat

SEQ ID NO: 8122 - DNA, 761 bp, Homo sapiens
tcaccaaattgatgcagtatacaaagaaagaggaaggcaaggaatactggaaccaggagcttcacaggatagtgggaaaaggaagcctaggatgaaagtgaagtgggatcccagggtgacagctttgcagcaggcacacagggcagaagataaagctgaactggggcaaagactacacttgagtaaaatcttgaacaatgtgagtgggaggaggagaaggcctggcaaattagaagcacaaccttgaagggcagagagacaagagtcttgctatgttgcccgggttggttttgaactcctgactcctggcctcaagtgatcctcctgcctcagcctcttatagtgctgggattgcaggtataagacaccacgtccggcccctggaagtttctggagttgtaaaatggcatcaagttgattttaaggaaaactcttctggaagcagagttcaaggtggattggaagaaggcagcctgaagttattctctcttccccatttccattgtccaaaatgttttattgtctttgaaaaagataaacaagcaatcctcattcctcactactacacttccttggtagaaacacaataaatatacagccactttggagaacttcaccaaatcaaatttatttccccatttctgaatgttaagccacaaagaaagtacaaccatcattagaataaatgaaaacagtaaataatgatgagtgggactttccagctctaaagtagacagactatgtgtgaactacaggcagag

SEQ ID NO: 8123 - DNA, 303 bp, Homo sapiens
gtgcagccttatagatggtcatgtgcctggaaatatgcccatcatgcagatcagggttgtaggaaagctcttggcttgacttcatatgctggggttggtgggcaaggaagatgacatggtgtcattgtacataatgatgtccttgtcacagaaggtcatagtgctttgtcaggtgattttcccatgccgacctcctctataagataattttacatagtgggatagtgagattgaataggagtttcaaatctgtgcttctaatctggagtttatgctgagtgggaaatgaaatattagcaagga

SEQ ID NO: 8124 - DNA, 469 bp, Homo sapiens
caatttatagaatatattggttaatataagaataaattttagccatgcacatctattacaaacttcattttatactttgctatttttaaatttcttatgctcttataaaacgtgtgttctggactcacgttggcttccatttcttccctctggcttctattagtttaggctatgagcatagatggaagaggtggctgttgtattggatcaaggatatgagcagagatggatgaggcagcggctgtaatggttcaaggctatgaacatcttgtgaagtaggatgttaaatctgcaaatatcagagtgaatccaaacttatcaattcaacactggattgtaaaacagctcaaaaaaagactaaaaacacagctctacactttaggaggttggggcaggcagattgctcgagctcaggagtgggagacaagtttaggaaacatggaaaaaccctgtctctaaaaaaaaaaaa

SEQ ID NO: 8125 - DNA, 673 bp, Homo sapiens
ttaaattgtcttgatatttaaaaaaataacttctacattctcaggaagaaatacatgaagtaaatcatatctccatgtctgtttccagatttctctcatctttttactatcccaatacattcctaattcctataaacgtagtggcttaaatactgaatacctggcagctcttaaagatcccttaggcagatgatgataattttcagtgtttcgtcatgtttaatagaaatcaaactgacttgtgttttaaaatacaagttgtctgctagtaaagttacatgatttaggtgtgttttaggttttctgcaacaattagctgtgaacccctaatgtagctaagtttatacaaattttataatcaaaattatttatttttatttttttagagtatgtcaaaaacatatagtgtttgctttgtgaaatacatttgcttagagttataaaatatactgtgactcagaaattgtaaagtcagtttgcgttgtaaaaatgaatactaccagcatgtcaaaaggaaaaataatttacatttgtaatataaagtaaaattgtatttaatatatttattggaattttaaatttgcactaacttggaaaactttaagggttatactaatttaatgattaatgtggacccaaatacataatttggccaaaaaagtcattagaatgg

SEQ ID NO: 8126 - DNA, 439 bp, Homo sapiens
gtcccagtgaggtttattcaggtaggctctaagggtaatcatagaatttatagatatatttttatgcacaaaaaggaacctctgtgagagagagatgaaaaggacaattttttaaaaatggcttctaatggcaggggatgtactctctaatttaattttcacaatgaccctgactgaagtattagcagtctcattttacagatgaggaaactgagactcagagaagatgattaacttaacatggtaaaggcaaagtcaggattcatgcccacatctgatagaactaaaagcccagtctaccaaggaatagagaataagtataggttttggacctggataattccggattggaatcctggatctagtactaaatagctgtgtacattggtcaaactaatgaacttccctatgttctaatttcctcatcggcaaaaaaaaa

SEQ ID NO: 8127 - DNA, 122 bp, Homo sapiens
ttttccggatgcactatttctgaatgctctcaatcttctgttgttcttattgcattcttggctttggaccattgcactgccttaatacattatttctatgtgatctctggcctttggctact

SEQ ID NO: 8128 - DNA, 465 bp, Homo sapiens
gatctgtttgtgacaattcatagtactttctctgctacacagcaagatgatacatgtgcactgtgcatgaacaagggacagaaggcagcattcccctttaggacagtgatgatgtggtgagggtctcccttcattcatgtcaccagcccccagcacaatgcttggcacattgttggcacatagtaaatattaaatggaactcttttggggagatacgttttttactccacttagaatctgtttaaacatgaataagttatttaaccttctcttggcctctctttataccaaataagcatgcaatatttagttcttcataaattcgctcattcaacataaatttattgagaaaatattgtgtgcctgatgtgattactagggactgtactttttctagttcattgtaggtgaatgaactgaccaagtaccatgtgacaaagctaggaaagacttacttgaaggaaa

SEQ ID NO: 8129 - DNA, 301 bp, Homo sapiens
gaaaattgagcaaacgaaaattaaagcaatcttaacagtgagggctatgaaaccgttgaaaattctcccaagggaagtgatggaaacctccttgcttgagtcatttcaaagtcgacaaaacaacgaaaaatacatggagggagggatcctgtagtgttggggagcagactcgatgatttcatagttcttttctgtctctgatttccatgttctgtgaaatagtattgcagctaagaaacatgaaatccttcactccgacagtatgttcacagaaaattcatctgaagcacaaagttgaaaa

SEQ ID NO: 8130 - DNA, 436 bp, Homo sapiens
gtccccatacagctcccaggtggaaactccagagcaagcgtgtcattcatacacccctgggcccagagatgtggacgtgtccagcacgcctgttctctccaagtgaccaggaggagacaatccctaggagctgacacaggtgacgaaaggcccgaggtggcccgccttttcccccggccccattcccatgtgtccttccccaggcagggatttgaagtgggcagagtcttccatgttctcccaggagaggttttctgggtgcccctctcccccttcctacggttcccctgccccgccaccctgggcacccctggggctgcctgccgcaccctgcagccgccacctggggaagccggcttttatctcctgagccctgctttgtaaacctcctgcagagttggatgtttataataaaggccgtttatagacctaactc

SEQ ID NO: 8131 - DNA, 765 bp, Homo sapiens
gttagccacgtgcctggagggggccagctttgcagcatttcccgttgctgtacaattcctgagtgtctgcatggccactggatttgtatgtgtgcattttctgattttctaattcaagtgatggtttagggaagaaaaccatgtccgtggtctgtcctgtccaagtggtgaagagcatttgaatccacacagcctaagactccaccttcctgagattcacagtcttcacatgtactttctgtggtggctcagataagcacacccttttgaccaatggaccctttttgactgggaacacggttcttgaccaaggagcccagatcctgcctgtcctcgaagctgcaatagcgaaccgcacactgccctctcgtggcggtccggagggtttcattctgaaactggaggattttcttttcaaatctagacgttaatgttctccttcctgtgcaaagatgctacccgggcacagcttcagcgtgtggtgcacacgaggccacctctttcccgaagtgaggatagacttcagctgttcttgctgcaaaatcttccactgtctgagaggtggtgggttgggtcacagagctcttccctgtgagaacagatccttaaaactgacgtcccattttactgggctgcacgagcactcaaggcaaaatttccttagttttcattaagaagtgccataattcctgttggtgttgtttatttcttatgttaaaaaagaaacaaacgagttgggaaattttcaattgtgtgtaatgcagt

SEQ ID NO: 8132 - DNA, 364 bp, Homo sapiens
  misc_feature (334)..(334): n is a, c, g, or t
  misc_feature (358)..(358): n is a, c, g, or t
cctcgcattttgcactgcagtttcagagttgaatacttgtagttgtgatgttgattgtatgacctacaaagcctaaaatatttgtgtatttgatgctttaaactttggtgacccccagtctattgccttcctactcaaaagtatggtctctggaccagcagtcttggcatcacacatggtataactaaatatgcagaatcataggcttctctctgcactcacaaatacaggcacattgatgctcaaagagaatccaaggaatgtattagggaatatatgggccgtacgtggtgggctcacacctgttaacctcagcttcccaaactgctggggntttacagggttgagccaccacgangggccg

SEQ ID NO: 8133 - DNA, 481 bp, Homo sapiens
ctcttttcaaatcaaattcttaggtgataaaatataaaatgacctctttgtccatttgagctgggctggagagaaacttgacattctcttgtctgcacagatcctaagctataccatccaggtggcacggcactggaggagagccttgttgcagctaaaacctcacataccagaagatatttacttttgttttataaaatttgcagttggaataattatggctcaggatatgtaataatttcctacctctcattggctggaaggttacttaggccatgataagccttccacatttcagagaaggaagaaactctaaacactgaaaatatctgatagtcattctgcaagaggtgcattatacaaagcaatgcataatatgtttatatctatgggtaatacacaaggttccttttaatgtatttgagatttttcaagagtgccaggccatcccatttaggacagccaacatcagcattgtcct

SEQ ID NO: 8134 - DNA, 346 bp, Homo sapiens
cagagccggcactggcataggtgcacacagcctgacttcaaacaggcctatccactgggctggctgtgtgactaacaaataaatgttaagtacgcaaatttacacttggccatgacttgctcaaaattggcttaaaatgctgcagggtatgattctgaatcagtaaacaacaatacatttttcacttcagtcagccaaacacagagttcaaataagattttgaaattagaattcagactcattgccatttaggctgtgaattaacagttaaaaattagtctccgttcacattcagcttaggtttgatgagcaaaactgccaaaagaaagcatctgtttttgcggtt

SEQ ID NO: 8135 - DNA, 918 bp, Homo sapiens
aaagaaagtaactttcaaatctaaaattctgtacctggtaagcatattctttaaatatgaaggtggttgaaaaacgtttcaggcaaaataaactgggagagcatatccctgctaaactctcatttaaagtacctcttagtagaagaaaaataataggagatacagaaaggaaaatggagcaataggtatgagtaaatctaaatgaatgttgacttaggaaacaataatatcttgttgatgtggtgtgcgtatatgtatatcacatagcagcaaatgtactaaaagggtatggaatttatgttctaaggtccatgcatagtctaggaagagggtgaaaagtaccaatattagatgatatgtaaaaatctgttcttgtaatgtctagagtagtcactaaaagaataataagtacatataattaccaaggtgtggagagttgtggggatgtggaatagttaatcagtataaacaaaggccaaaaaaatgagaaaaagaaataaagaacagatggaatataatgagaccttggtaagttggtagatctacaaatatactataattatactaagtgtgaacagacaaaatgttccaaattacaagacaggtttcggactggataagaaggaaaatagaaaaatgtgctattttctttttatgagaaatatctaaaaactcaatgtataaaatacttaatgggaaaagacacaccatataaatattaaccaaaggcaagatggtatagtagacaaaatccattatttgaggtaaagagggacactttgtaaggatgaaagtctctcttcatctgaaagatatgagttgtaaatttatacaggttataaacttacaaaaaaatgacagaatttcaaactaatagaaaactccatagtcacagtggaaaatcttaccactttatgc

SEQ ID NO: 8136 - DNA, 233 bp, Homo sapiens
tttttttttttttttttagtagaaatggggtttcaccatgctgaccaggctggtctcaaactcctgacctcaagtgattcactcaccttggcctcccaaagtcctgggattacaggtgtgagccactgcacccggcctgtttattctatttcttaacaatagccacaacagtacaaacctcatcattacttggggaaaagttgacacagtttaaaatttgtcgacttactgac

SEQ ID NO: 8137 - DNA, 707 bp, Homo sapiens
gcctgtaatcccagctactcgggaggctgaggcaggagaattgcttgaacccaggaggcgaaggttacagtgagccaagatcgcgccactgcactgcagcctgggtaatggggagactccatctccaataaaataaaacaaaataagataagataaaataagataaaataaactggagcagcctggctccagagaccacactccagatcacagctctgtaccaccattcaaggatccagccagtcaccaagtagtttgtattcatctgctataataacttctttgcagttcactgtgacttcgttccctcctacctttgttacttcctttgatggcagcaaaggctgcctcactgatttcactaccaccagtcccatcctgttcatcttggaggtcgcagacagcttcatcttcctgaagtacctctttcgtgcttctgcttccctgttctaaaaccttttttaaaaagttttattgagctgtaactcacaaatcctactacactttacccagttaaggtggacaggccagtgagctttcgtgtattcacagagttgtgtgtcagtaccacaatcaattttaggacatgttcatcacggcaaaggaagccctgtacccctcaaggatttaaactaacgaaaaatcaataaataaatgtggatttgtgctcttgtatttttaagtggattaaaaaacttactacctta

SEQ ID NO: 8138 - DNA, 354 bp, Homo sapiens
atatggattaaagatttacctcaacttgtaagaatcttagaagaaaaccaggaaacattctgtacatcagttttgggaagtaatttatgatgaagttacaaaagcaattgcaacaaaaataaaaattgacaagtgggacttaattatactaaagagcttctgcacatagaaactatcaacagagtgaacagttagcccacagaatgggaggaagtatttgcaaactatgcatctgacaaaggtctaatatccagaatctataaggaacttaaacaattgaataagaaaaaaacaaataataccattaaaaagtgggcaaaagacatgaacagacacttctcaaaaaaagacata

SEQ ID NO: 8139 - DNA, 515 bp, Homo sapiens
tttttttaacttggccgggcatgatgacctatgcctctaatcccagtactttggaaggctgaggcagaagaatcgcttaagatgggaagtttgcggctgcagtgagctacgatcacgccactacacttcagcctgggtgatgcagaaaggaccgtgtctctagaaataaaaataattttttaaaaactgagtaagtcaaatgtaaattttccttttcaaaaacaaattattcagtatgcaaaacattctgttaagacatattttctgataaccttagaatacgtggtacttaaaaactatgactaaaatatttgtggaagaattcattatcttaggtgatacattttaacaattaaaatagttccagaacacggtcttccacctgactttgacgattaaaacaatgttgtcaaaagaatgttctctctgaaaattctgggtctcatccaccaccataggtctcatctaccatcaactgaaataagctaatcagttataaacaagggaatatactt

SEQ ID NO: 8140 - DNA, 401 bp, Homo sapiens
aacatatgatttgtatgtgtgtgtgtatatacatatgtattttccaagcactgttcattgaaagggcctagaagcaattacatctcagtagcaatgacgacaccttgattttggtttctaaaaatcacctgatacacctgtaatcccaacactttgggaagctgaggcaggaggatcccttaagcctaggagttcgagaccagcctgggcaacatggcaagacccccatctctactggaaaacattaaaaatgagctggacatggtgtcacgcatctgtggtcccagctacttgggagactgaggtgggagtatccccttgagtctgggaggtcgaggctgcagtgagccatgatcatgctattgcactccagcctgggtgacagagtaaaacctcttctc

SEQ ID NO: 8141 - DNA, 537 bp, Homo sapiens
gtttcctctccacttcttgctatgacaaggcacaggcagtgcatgtctttgtacttgaagcagggagcacatcatgagtatttccaaggactagagtccaaaggtggaattgccaggttgtttagcattctgatcaacaatggctacttgccccaaggtcgtactgactgatgagagtgtttgctttccctcagccatattgatgaggttctctttttaatatttgctaattttgtgagcaaacaaaaatgtctcattttggctaggtatggtggctcacgcctgtaatcccagcactttgggaggccgaggtgggtggatcacctgaggtcaggagttcgagatcagcctgaccaatatggtgaaaccttatctctactaaaaattagccaggtgtggtggtggaggccagtagtcccaactacttgggaggctgagatgggaggatcacttgagcctgggaggtggaggttgcagtgaactgagattgtgccactgcactccagcctgggtgacagagtgagaccctgtctcaaa

SEQ ID NO: 8142 - DNA, 379 bp, Homo sapiens
aagaaagagctcttttaagtcagaagaaagaaatggaagaaaaatgtgaaagtccatgacagggccattaatcctttatgtaacaaatgggccaggtgcagtggctcatgcctgtaatcccaatactttgggaggctgaggcgggaggattgcttaaagccaggagtttgagaccagcctgggcaacaaagtgagagaccctgtctctacaaaaataataattttaaaaaattagctgggcgaggtggcacacacctttagtcacagctacttgggagactgaggcaggaggatctcctgagcccaggagctcgaggctgcagtgagccatgatcacgccactacagcctgggggagagaatgagaccccatttctaaa

SEQ ID NO: 8143 - DNA, 435 bp, Homo sapiens
taggtgagagcgaattgatactagagatgcagaaatgtaaggcttagaagctcaagtgtccaggaccacacagagctcataagtggcagagccaggatttaaactcaggtttgactgatgtcaaagccactccttatggtctttttgatatttttgctctagagatggtgttcatgattagcttgtttacttaccaaccattttctattcagattataaagcagatctcatttggccgagacttggagatttaagtttttgatatgtaatctatgattgaatttaaatgaggtatggttagaaagttccagcccagttagtaatttagcaccttaaagcattcaacaagcatggttaaccaaaaacctaaatcatactaaatgtttgaagtggtgaacaggagggaatatttttatattgttactagtcagcttt

SEQ ID NO: 8144 - DNA, 357 bp, Homo sapiens
gatggatccatagtgtttgagagtaagcaaagtaatgagtaaagtaattggtttggaacacaggattcatttacagaaggaagagaagataaggttgaagaggtacgtaggagacaattgcaggttcccctgcagctgcggagtttggacaacagggagacatttattcaacatatacatgtgtgcctgctacttgagagatgttgcagtgggtactagctagacatctctgaaaaagatatttgagtttgaagagagtgtgaggaagatgaacttcactgggaaatacagaatagattaccgtgaagataagccagtttaagtagtattgaaacagcccaggttgaaaaaaaaaaa

SEQ ID NO: 8145 - DNA, 433 bp, Homo sapiens
attccagaacaaagaatactgcgagaaaaagtaggctcaggctggggaccccaaaatcacgcatttccctttctccctgaagccagctctcactgcacctagtaggtatacaagagtgcattcatgtgcctacacaaatatgcacacacaaaactaaagaaaggatgtcacttgagcacacagcttcctgccccctccaggagtcctaactgctcagcagagaaaaatagcttagaggagcataaagagacccaagaactcttcctcttggctttcccagtaacttctggaattacatttggaaagtcacttcacccccaagacctgaatctcatcatttataaaaggactgaggctgcaatatgtgaaagatcaggattttcaagctatgttctgagcaaccaaaaggttctgagtgctataaaactctgca

SEQ ID NO: 8146 - DNA, 372 bp, Homo sapiens
tggtctgtatatgtgctaagtggtgtgccaggtgccctcagtccctaccttacatgcagcttgttttagtcatttctttcctggcctctatagacctgtctttgcaacctttacctagcccaagaggtgatgaaagtgcctgtcttctttatactataacaatttgagaattaaattgctaaatggatgccctatcaccctctaacattttagtgtttatttcctgtaagtaaggctttctcctacacaaccatattacaaccaacagaatcaggaaatgttgatacattactaattctcagacccattctagtttcactaattgtctcaataatgtcttttatagcaaaaagatctagttcacaattacat

SEQ ID NO: 8147 - DNA, 449 bp, Homo sapiens
aaaaagtaaagtattatagtaggacttttatttatcacaactctcctgagttttcaaaactttgttttttcttataagaaaatgatgacattcatcgtagaaaattaggaattatagggaaaagaaaagaaaataatatcactcaaagataaccactgttgggtcaggtgtggtggggcatgcctataatcccagcactttgggaggccgagacaggtgggtcgcttgagcctgggagttcaagaccagcctaagcagcatggcaaaaacctgtctctacaaaaaaatacaaaaattagccaggcatggtgatgtgcgtatgtggccccagctacttgggagctgagatgggaggatccacttgagcctgggaggctgaggctgtggtgagctgacattgtgccactgcactccagcctggagcctgggacaaagtgagaccctgtctc

SEQ ID NO: 8148 - DNA, 313 bp, Homo sapiens
caaaaagaaaaaaaatgaagaggaaatttgctgtgaaacttgcttagagatgataacctttctactttgactattgttggcaatcttgccattatttttattgacacagttgttaggtactcatcttcctctccaaccaggggcttggtctatttgtgtttgaaattgattgctgggactgtcacaaagtaatttatatagcaacttattataattagttatcatttgcagtttcctaaatgtgagttgcattttatgcttagcaattgatttttctgtatatctccatgaagcagctcaatgtatgccatcc

SEQ ID NO: 8149 - DNA, 331 bp, Homo sapiens
tatctttccaagttattttactaaattgcttcatacaattgcttttgtcagtcaagtaaaatagtcatttcgattgcattgtatgagcaacatagaaaacaactactgcaaaatataatgggaaattaaactctcacaggttgtaaactgtctccctttgaatccttgtctgaagaaattaatttgaactatgccttctaaataggtacaggtgagtcatctagatttcattaaacatttttattttaaggtttttgttacttggttcttttaaaaagttaaactttgtttgaatttatctttcaagtatttccttttcagcttgttcacc

SEQ ID NO: 8150 - DNA, 514 bp, Homo sapiens
gccttttgcctcctgtcgtgattctgaggcctccccagaccatgtggaactttctatcagatttcgcttcaaaaattttggacctttgttactaggtacataaacatctgaggtgtttattggagctctttgcctagaactgataattggattcatggtattctggagaacaaggaagaaaactgaagcccagaaagcttaatatattacccaaagagttagtccacattgaactgggagttaatccttgtctgtctggctggaaagcttttgctctgtatcttggatgaataaactaaaccttagggaatcttcctagaagaaaccatataacgactcctgtacgagaagttaaattacaacacaaagattgcttggtgagcatgtgatcaaaacagggcaagatgaagacctttagaggccacaagcattttagtgtgcctcccaacttcccttatattattcaaaatataaacaataaaatctacaaagatgtgaaagaagtccaaaaaaa

SEQ ID NO: 8151 - DNA, 550 bp, Homo sapiens
gccttttgcctcctgtcgtgattctgaggcctccccagaccatgtggaactttctatcagatttcgcttcaaaaattttggacctttgttactaggtacataaacatctgaggtgtttattggagctctttgcctagaactgataattggattcatggtattctggagaacaaggaaacaggctgaggaagaataagagacttgcttgaggaagaaaactgaagcccagaaagcttaatatattacccaaagagttagtccacattgaactgggagttaatccttgtctgtctggctggaaagcttttgctctgtatcttggatgaataaactaaaccttagggaatcttcctagaagaaaccatataacgactcctgtacgagaagttaaattacaacacaaagattgcttggtgagcatgtgatcaaaacagggcaagatgaagacctttagaggccacaagcattttagtgtgcctcccaacttcccttatattattcaaaatataaacaataaaatctacaaagatgtgaaagaagtccaaaaaaa

SEQ ID NO: 8152 - DNA, 237 bp, Homo sapiens
tgggattacaggcgtgagccaccgtgcccggcccatcgtatctatttcaaagtgtgaatcaggagagagggtggtatctgctgcgtctgctccttacttacgtaaagaaaggaggttattccaccaagatcatgccattgcattgcagcctgggcaacagagcgagactctgtctcaaaaaaactaaactaaactaaaataataaaaatttaaaaattagaaaagaggctattccag

SEQ ID NO: 8153 - DNA, 446 bp, Homo sapiens
gtggacagacatttggattgttttcagtttgaagctttaatgaataatgctgcagtgaatatttctatacatgtctttgtgtgggcatgtttttattctcctagatggattctaggagtggaattttggggttaaaagttgatgtttagctttttaaagagactgtcaaactcctttccaaagtggatgcccagttgtacattctcaccagcaatgaacaagggttccatttcctccacatccttaccaacacttaatattgtctatctttttattttagccattctagtggctgtttagaagtatcttgttgtggttttaatttgtaccttcctaatgattaacaatgttggatatcttttcatgtatttattagccatctgtatctcttctttggtgaaatgtctgtcaaaatatgttgtccatatttaaataaggttgcttgt

SEQ ID NO: 8154 - DNA, 542 bp, Homo sapiens
gtaccctgtgtctcattcttcctgccaaagactgcaataataaacatgatgaaaaaccattcatattaacactgaaccaaaaaaccctccaagtatggataagggccagtctacccattcatcacctccttagttgccagtcaatttccagtcaagtagcagtgggaatgaattatctaaaagctctctgctagcatacacgtgaaataaaatttagcctcagtctactttcttaaatagaaacttttgctctacctttgagggctgggcgtggtggctcacgactgtaatcccagcactttgggaggccgatgtgagtgcatcatctgaggtcaggagttggagaccagcctggccaacatgacgaaaccccgtctctaccaaaaatacaaaaattagctgggcatggtgatgcacacctgtaattcctgctactcgggaggttgagacagaagaatcgcttgaactcagaaggcagaggttgcagtgagctgagatcatgccactgtactccaacctagacaacagagtgagaatgtcta

SEQ ID NO: 8155 - DNA, 254 bp, Homo sapiens
taattagtggcattttagctttgctaaccattcttttaattctgcttctaagttgttatcttttgtattcatagtttcacagtcccttataaactctcacttagattattgtaactacattctgtttccacttcttattccttgtgtcatgccttgatattttaaccttcagtctttgttggagttaccttcactcacagtttgaattttcccacaaagttagaatgcttcttttctttagcatagtattgaaa

SEQ ID NO: 8156 - DNA, 262 bp, Homo sapiens
ttttttctctctagtgtctctctcatttcaaaaaggcaaagaatcctgaacctcctcctggccacaagtaacctatataacatcaaacctaagcctcctttattctgtttacaaaaactttgcagaataaagattgaatctgtacctccttcctgccttgagaaagtaatccatcaaatagcactctagtttgcaaaaggatttttggatctcaaactccatagaggtttattttattatgtatagattaggatgtggaagg

SEQ ID NO: 8157 - DNA, 324 bp, Homo sapiens
cagtaattcgagacaattatttttctcctgacacaacatcaggtcccatgaaaaatgacacttgctggcctggcgcggtggctcacgcctgtaatcccagcactttgggaggccgaggcgggtggatcacaaggtcaggagatcgagactatcctggctaacatggtgaaaccccgtctctactaaaaatacaaaaaaattagccaggcgtggtggtgggcgcctgtagtccgggaggctgaggcaggaaaatggtgtgaacccaggaggcggagcttgcagtgagccgagatcgtgccactgcactccagcctgggcgacaga

SEQ ID NO: 8158 - DNA, 402 bp, Homo sapiens
aaaaaaaaaaaaaaaaaaaagtatttcaacctttgtgtaagagcacactcaagagtgtgttgtttagtttctatatatttgtaaatttttcagtttttttttttgcttttatcgttgtatactctcattccattttggtcatagaatgtagttcatagaaatttacttttaaaaaatttgataagacttcctttttgtcctaagatgtggtctttcaagggaaatgttgtatgagctattgagaagggtgtgtattctgatgttgttgaggagtgttctccataactctgtttggaataattgttttatactgcctttaagtagtctgttctcttattaacattctttcttgttttatttttattacaaaaagtgtggtattaaaatatattgttctaatta

SEQ ID NO: 8159 - DNA, 250 bp, Homo sapiens
gattaaaggtcagtttgattgaggttttgagctttagctccttgccaaagggaaatgtaattcatgacatgctgggcatctcaattaagcaattacctgtggttgatcctgatgaagtgccaactgaagcctgtgccttggggccccaagtggctgctacacttgactgctatggttataaagatgactagaaagactggtgtgggatggattcttttgcgtgcttttgagtggttataaagagaaatga

SEQ ID NO: 8160 - DNA, 595 bp, Homo sapiens
agcttcaaaatatttttgcaacctaccacagaaagccaggtagttttaaagaccactaagaataaaaatagatctggaagtttggcgcaaggctgagttgagtctttaggtaccaaaatgatctaagtcattggtactgtagcatgggatctagcagataacagggtttgtgaaaagctgtgtaatatgacggaatgtgtttgggctttggaatcaagctggattcaaatgttcgaactgccactttctaagggaccctggccagttaatttaagttccctcatcacagcgttctcatctacttcacagggtttagttagagtgtgtaaagtaggccaggtgtggtcgcccatgcctgtaatcccaacactttgggaggctgaggtgggtggatcacttgaggttaggagttcgaaaccagcctggtcaacgtggtgaaaccctgttaaccaggcatagtggtgtgcgcctgtaatcccagctactcaggaatcttaagacacgagaatcgcttgaacttgggtagtggaggttgcagtgagctgagatcgtgccactacactccagtctaggagacaaagcaaggctccatctc

SEQ ID NO: 8161 - DNA, 227 bp, Homo sapiens
agagtgacaaaagatgcctggcaaacatagaagcttgccctttgaaatgtttgatgttttcctggaaaagtcacagtcaggtgcatttaaaaaggaaaaagcacagaacatcaaagctggaaaggggcttaatctaatccatctactgaatttgactggttgagaaaactgaggcccagagaggggaagggatttgtccaaggtcacacagcagtaagtggctgctg

SEQ ID NO: 8162 - DNA, 718 bp, Homo sapiens
ttcgttcttgtcatccaggctagagtgcaatggtgtgatcttggctcactgcaacctccgcctcctgggtccaagtgattctcctgcctcagcctcccaagtagctgggattataggcgcacgccaccatacccagttaatttttgtatttttagtagagatggggtttcaccatgttggccaggctggtcaggacaacctgttcgctttatagagagggacaaacctggatggcaaagccccttatcaggagtccccatgagtcagtgacagtgaagaccagcccctttcctgcctctgccctgtgtcccatacccttgctgtattatgtggctttcagtgtgattgttttaatcattaggagtgctattttgtttagaagcaacagtggccttcaaataacttaaagtcgcaaaataattatgaaagtatcaactgatgtatctagcttgtggccagttaacaaccactttgtgtgcaccattcataagcataaagttctgtctgaaggaagaaaatagcatctttattattagtcagccataactcattcactgtgtaatgcctcagttattatagggtgagtgccttgcaaagctgtttgataaaagataaatcttaagccaggcatagtggctcacacctataatcccaatgctttgggggctgaaacgggaggatcacttgagggctggagtttgagaccagcgtgggcaac

SEQ ID NO: 8163 - DNA, 389 bp, Homo sapiens
gcaatagtgaaatatcaagtgagtgacgcttgatcaacagcctactgcttaagaaattaagctctgatgtaacagcaactaacttcatataacatttttaccactgaaaaattgtatgatctggaacaaattacttcatcactcttaatttcacttgatccacagtatgggcatagcaatagctcttgattgttgtatttaattctattgagtaaacattatatggtaaataaggaccattattggttttggtagagtttgggtgaggtgattaatggagtgaatcactctgtcatcttgcccttcatatctttttcctggtttcatcacacacataaattgtcaagagtgggtcataaaatgtagctttgtaaatctcttaacttgga

SEQ ID NO: 8164 - DNA, 1299 bp, Homo sapiens
aaaaagtcattagaatgggtaatggttttgtgtggttttccttcaaaatgataatattgaagcaagaaccagcattttatattgataatttttttaatatttctacccagttgaggacagtggaatataagtagatatatttaaaatatctagatatttaaaaagaaagaaaaggttgtttatcccaatctgaattcattctcagcaacaagacagaaaaggtggtttgggttttgcttttaaacagtgtccccctgtctttttcaatttttcccttgaagcctttctcttgttcttcagagtacgcgctgcaggctatctgcagcatcagaatgcctgggcaggctgttgaaagtatggattcctgagcccaacccttaacttaatgattccctgtctctggagatgcaacatagaaatctctgtttttattaacaagcgcctcaggcgattcttaagcatactgaaatttgaaagcttctggtctgaacctcatgtattcacctagggcttttgctaggtgggataccatgccgaaaaattgaattaattgtatgttcttaaaattgtttttcttctactccactgtcctcttccctcaaaatcacttttctaaaagaactctatgaaaaacttatttgtatcatacccaaattgatatatttgtctgaactctgttacataaaaattggtatgattcatacgtggaatcagtttttggactgtgacccatgcagtgttgggggacaaggagttgcttcaggagttagtgcagtgcgcctccaaggggcagtgagccatggaaggcgcctgccttctcactgcagtcaatgcagccacacttgtgtatactgagtgctgcttcagatctcagtagataaaataattcccacatttaaaatgattctgctattttttataaagggtttgaaagccactactataatgactttgtcacctaattgattttctactaatttttacatattcagaaacttcgtgtttttttggtggacagaatattttggaggtctccgtcgctgtttagaatgtggccacttggctgtttcacagtttttaaagctattttattgaatagtaaagcagtgaacttagcctttgttctttgtgtttctaatttaagcatatagtctatttaatttttgatatgtaaatacacatcaatacatatatatttacccatgtggccctgtgtagtcagtgcatgaggcttgcatagcccagaaaggtacattccagggttctggggaaagaattttaaaatgccatcctctaata

SEQ ID NO: 8165 - DNA, 288 bp, Homo sapiens
cactccatttctctgtgaattgtctccttttccatggttcactctgcagtcactcggcctccctcaccctcagccctcctgagcctcccgcagcacctggcctgcccaactcccaccgaagcgccagcctctgggtgtctgcactccttgctttgggctcccaagggtggtgggagaaaattatacaactttgtggacttgacttcctacaggttcatggtcttcagcctttggtgggccctcagggggaccagcaagtcttctagatgtcccctccttatctggccg

SEQ ID NO: 8166 - DNA, 436 bp, Homo sapiens
gagaaaggtgctcctttcctcttttagttttctctcacccttccttcttttcacatctatttcttactgtttcctgcacagtgcttgtcttttctctgacattgtatgagcaatttctttgatacaatggtagtctccaattatgctactgggcaagccagcctagaggttgtggaacagaaaggctctcagaccaacttaagtcactcatatcgcaagttttattgaatcagctgaaaatatccagtactttcaaggggaaagatgtgagaaaggttcacccacttagcttaaggtgcaagcaggtggcaggaccacacgacccgatcctcagtgactcagtgttcatgtgaccggtgttctcttctacattgaccttccaagctcatggggtagttactttggaacaaggaggctctgcagagaaaactgcctg

SEQ ID NO: 8167 - DNA, 564 bp, Homo sapiens
ctgcctcagcctcccaaagttttgggattgtaaaggatttgtgaggtactgagcctggcctctgattgaattttaactgatttttattcttttttttcttacctctgttattcaagttggaaacaattgaatgtgatttcctgttaactacaaaaatatttatagtcatttttagagcatagatgttaagtagttaatttattttctgtaaagatttgtaagtcttttgaagtcattatcatttgaggaaaattattttacaaacttcgcatttctctttggataaaacaccactttaaaattgcacaaataagggccaggtgtagtggctcttgcctgtaatcctggcacttcaggacgcctagtggggaggatcgcctgagcccaggagttctagatcagcctgggtaacgttagctgagcatggtggcgtgtgcctctggtcctggctacttgggaggctgaggtgggaagattgcttgagcccaggaggtcaaaactgcagtgagccataattgccccactgcactccagtctgggcgacatagggaaatcttgtctcaa

SEQ ID NO: 8168 - DNA, 4119 bp, Homo sapiens
  misc_feature (31)..(31): n is a, c, g, or t
  misc_feature (178)..(178): n is a, c, g, or t
  misc_feature (793)..(793): n is a, c, g, or t
  misc_feature (890)..(890): n is a, c, g, or t
  misc_feature (1106)..(1106): n is a, c, g, or t
  misc_feature (1206)..(1206): n is a, c, g, or t
  misc_feature (3655)..(3655): n is a, c, g, or t
  misc_feature (3767)..(3767): n is a, c, g, or t
  misc_feature (3820)..(3820): n is a, c, g, or t
  misc_feature (3910)..(3911): n is a, c, g, or t
cttctacatcgcgaatatccctcgccggccnggcgcccggcgccatctgctggacccgttccggctggggcgcacagacctgggcgcggggtcgggcgattgggttctccctgccttttcaatgtcctgcggggcggtggctcactgtctctcgccccagcccttccagctgggtccngacaccaggccccccgcacccttcggctcgccagatgtggctactttcctttagtcccggagccttcaagccctgggtccctgaggggtagacctgggcggggtggggccgcgaagcagggatccagggcgcctgcgcggaggaggcgggctccgaggggccgcacaccggccactcgcccctccctgcccggggttgccatggggacgcgtgcagacgccggcccgagagggctgcgaggggcaacttcttagagtggcccatcggtcggtctagggaggggagggtcagcgtggcaaggtgtgtgtcgggggcagagggaaggagggaaggagtgctggggagaaggggcagtagtgtcggggtaggaagggacagttgttggggagaagaggcagttgtggagggagagggagcaaggaatatttgtgtgggggagggggaggagaaggggcagttgtgacagctgggggggaagagccattctgaggggaaatttgcctgctggtaaccagtttaaggataccagctgctggtataaatactgctggataaatactgctggatttatactgcaggataaatactgctggcccctgcggtatttcctagtantagagtgagccccgacttagcagagcagttcctcctggggcctgcggtgtgggatcgcgtggtgaaccccacggtgcatgcgcctcaggctctagtntgaggcaggaaagcgcagcttgatgcttctctggagactgatggaggaagcctccttgctgtagttggttttattgatttgctggcctaacagaacgtttttccttggagcaaagtacaaatccttcaagtttgaaattcataacctgagatcaatgcctgtggcagcctgtggggatgaggaaggagagccacaggtgccgttaggctgcagccnaatgaaaagagagtgcccagcgcctcagactttgcgcctgggattctgagcacctgtccgagatccccgcttcctgccatcctacctttctgagagaggnaccactgtgaccttcctcgtgccccaattgctttttcctcatgacacaatttgaaatttatgattggatgacttttgtccttctttcttccaatctgttctcagggcattttgagtcaaataaatgatcctgactgatcttaaccattagcacagagttcctcagccaactctgctaagagacctcagtacacacaaaacagtgttcctgcccctcaggacttcaaagcgatagacccaggttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtacaggagccacctggccccttttccctatactccccttctgcagctctcccaagaatttcactcccatcttttgactcctctcttcattattctctctctttctcatacaatatgtttgctatcgtcattttacttttttttttcttcttttatttttgtctctccccacctcccaccctgctatcaacattttaattttacaacttatcttaaaacacaacaaaacaaaacaatgatcggccaggcacggtggctcacacctgtaatcccagcactttgggaggctgnggtgggcgcatcgcttgagcccaggagtttgagaacagcctgggcaacatggcaaaacccagtctctgcaaaaaatacaaagattagctgggcgtggtggcacaagcctgtngtctcagctacttgggagggtgaggtgggaggatcgcctgagcccgggaggcngaggctgcagtgagctgagatcacaccactacactccagcctgggcgacagagtgaccctgcctcaaaaacaaaaatcaaaaaccactcnnctatctgactaaaccagtgatgtcgctgttctgccactagatggccataatggctcagctaagtcacccaaaccctgtccctttcctgactgttggtggggctgtcagaccatgccttcttctacagcttcattgttatgaaactgtcatataattatttaaaatgtaattaatcaattaactaatttattaaaaatatatagtgagc

SEQ ID NO: 8169 - DNA, 3151 bp, Homo sapiens
  misc_feature (31)..(31): n is a, c, g, or t
  misc_feature (178)..(178): n is a, c, g, or t
  misc_feature (2687)..(2687): n is a, c, g, or t
  misc_feature (2799)..(2799): n is a, c, g, or t
  misc_feature (2852)..(2852): n is a, c, g, or t
  misc_feature (2942)..(2943): n is a, c, g, or t
cttctacatcgcgaatatccctcgccggccnggcgcccggcgccatctgctggacccgttccggctggggcgcacagacctgggcgcggggtcgggcgattgggttctccctgccttttcaatgtcctgcggggcggtggctcactgtctctcgccccagcccttccagctgggtccngacaccaggccccccgcacccttcggctcgccagatgtggctactttcctttagtcccggagccttcaagccctgggtccctgaggggtagacctgggcggggtggggccgcgaagcagggatccagggcgcctgcgcggaggaggcgggctccgaggggccgcacaccggccactcgcccctccctgcccggggttgccatggggacgcgtgcagacgccggcccgagagggctgcgaggggcaacttcttagagtggcccatcggtcggtctagggaggggagggtcagcgtggcaaggttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcctttcccgagctgcgctgacaggactggcggatgcagtgtggacacaggagcatgatgccattctggaacactttgcccaggaccctacagaatccatcctcaccatcttcattgacccttgttttgggctgaagctagagctgggcatgcctgtacagacccagaaccagcttgtctacttcattcgccaagcaccagttcccatcacctgggagaacttcgaggcaactgtgcagtttgggacggtgcggggcccctatatcccggccctgcttcggctgctcggtggagtctttgcccctcagatctttgcaaacacaggctggcctgagagcattagaaatcattttgcttctcatctgcacaagttcttggcctgcctgacagacactcggtacaaactggaggggcacacggtcctctacatccctgcagaggccatgaacatgaagcctgagatggtgataaaggacaaagagctggtgcaacggctagagacctccatgatccactggacccggcagataaaggagatgctcagtgcccaggagactgtggagacaggagaaaatttaggtcctctggaggagattgagttctggcgcaaccgatgcatggacctgtctggcatcagtaagcagctggtgaagaagggagtgaagcacgttgaatccatcctgcaccttgccaagtcgtcctacttggcgccctttatgaaactggcacagcagatccaggatggctctcgtcaagcacagtcaaacctgacctttttgtcaatcctgaaggaaccttaccaggagttggctttcatgaagcccaaggacatctctagcaagctccctaagctgatcagtctcatccgcatcatctgggtcaactctccccactacaacactcgggagagactgacctcgctcttccgaaaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtacaggagccacctggccccttttccctatactccccttctgcagctctcccaagaatttcactcccatcttttgactcctctcttcattattctctctctttctcatacaatatgtttgctatcgtcattttacttttttttttcttcttttatttttgtctctccccacctcccaccctgctatcaacattttaattttacaacttatcttaaaacacaacaaaacaaaacaatgatcggccaggcacggtggctcacacctgtaatcccagcactttgggaggctgnggtgggcgcatcgcttgagcccaggagtttgagaacagcctgggcaacatggcaaaacccagtctctgcaaaaaatacaaagattagctgggcgtggtggcacaagcctgtngtctcagctacttgggagggtgaggtgggaggatcgcctgagcccgggaggcngaggctgcagtgagctgagatcacaccactacactccagcctgggcgacagagtgaccctgcctcaaaaacaaaaatcaaaaaccactcnnctatctgactaaaccagtgatgtcgctgttctgccactagatggccataatggctcagctaagtcacccaaaccctgtccctttcctgactgttggtggggctgtcagaccatgccttcttctacagcttcattgttatgaaactgtcatataattatttaaaatgtaattaatcaattaactaatttattaaaaatatatagtgagc

SEQ ID NO: 8170 - DNA, 1611 bp, Homo sapiens
  misc_feature (1147)..(1147): n is a, c, g, or t
  misc_feature (1259)..(1259): n is a, c, g, or t
  misc_feature (1312)..(1312): n is a, c, g, or t
  misc_feature (1402)..(1403): n is a, c, g, or t
ttttttttttcacttgccatcactcacagtgatgtttttagacatttgaagctaaaccaaatagcttaggactttggagtttggaaggaaagcaggaaccctcatgctgtcttcttttttaggtatgtgactgtcagtatcacttcgcccgctgggaagatggcaagcagggtccccttccttgcttctttggtgcccaggggccacagataacacggaacttgctggagattgaggacatctttcataaaaatctgcacacgctgcgagccgttcgcgggggtatcctggatgtcaagaacacctgttggcatgaagactacaataagttccgtgccggaatcaaggacctggaggtgatgacccagaacctgatcacctcagccttcgagttggtgcgggacgtgccgcacggcgtgcttctgctggacaccttccacaggcttgcctcccgcgaggctatcaagcggacttatgacaagaaggcggtggatctctacatgctgttcaatagcgagctggccctggtgaaccgtgaacggaacaagaaatggccagacctggagccctacgtggcccagtattccggaaaggcgcgctgggtgcacatcctccggcgtcgcatcgacagagtcatgacctgccttgctggtgctcatttcctgccccgtattgggactggaaaggagagtgtgcacacctatcagcagatggtccaggccattgatgagctggttcgaaaaaccttccaagagtggacatcaagtctggacaaggattgcattcggcggttggataccccattgctgcgaatcagccaggagaaggcgggcatgctggatgtcaactttgacaagtacaggagccacctggccccttttccctatactccccttctgcagctctcccaagaatttcactcccatcttttgactcctctcttcattattctctctctttctcatacaatatgtttgctatcgtcattttacttttttttttcttcttttatttttgtctctccccacctcccaccctgctatcaacattttaattttacaacttatcttaaaacacaacaaaacaaaacaatgatcggccaggcacggtggctcacacctgtaatcccagcactttgggaggctgnggtgggcgcatcgcttgagcccaggagtttgagaacagcctgggcaacatggcaaaacccagtctctgcaaaaaatacaaagattagctgggcgtggtggcacaagcctgtngtctcagctacttgggagggtgaggtgggaggatcgcctgagcccgggaggcngaggctgcagtgagctgagatcacaccactacactccagcctgggcgacagagtgaccctgcctcaaaaacaaaaatcaaaaaccactcnnctatctgactaaaccagtgatgtcgctgttctgccactagatggccataatggctcagctaagtcacccaaaccctgtccctttcctgactgttggtggggctgtcagaccatgccttcttctacagcttcattgttatgaaactgtcatataattatttaaaatgtaattaatcaattaactaatttattaaaaatatatagtgagc

SEQ ID NO: 8171 - DNA, 822 bp, Homo sapiens
tagaggcagcattaaattaaaatttaattaaaatattaaaaataaagtaaaaaattcaaatatacaacagtagactgtctggcttgcatacaaagaaggccattgcccctttgggtgagccgggcaaggtcagggtctaagaagcgcctctggtgagaagcggttgtcaggctctgatggctgcgggaggagtgactcctcccaggatgagggtctgtgtcctctcagtgctcactcaagttccgtatttccaagtccttccagggggcgtaacgcacgtgagaactgccatttctgtcacagatacgtggccgcatgcatttccaggaaatgtccttggttcgcgaactacagctggcacaatccagcccagggcgttctgtgagctgtagtctccagcaagtgaattccaaaaaaacctcaaagacctcaaagaccatacagggtggacagcgtagtagcagggtttgggaagagaggagctcttttgctagcaaaggcgagagctcgcctggtacaaggtctgcccacgtcccgggagataaacattagtgtgagcgcacgctagacccagaagagtttgccacggccgcacggttttctgggaagtgtagtttcttggtcccggcgccattgtccttaaaagtagagggtggcccttggttccgaggtgtatctttcacctcatcagtatgactatatgccccaggacacttcccgcatggtcctaactgccgggctctgggacgacagccccaggcggtttagttttttaggaaaccgagatctgtttgcccgcggcgccccaggtccgcgcggccg

SEQ ID NO: 8172 - DNA, 458 bp, Homo sapiens
gtagggagaaagatgaagagctcatcccctactgcacaaccagaagtggcaggtatcacttgtactcacttcccatgttcagaacttaagtcacatgaccacatctagcttcaaaagagtctggaagtatagtcttttactaagtgacccttgcacctacctaaaacctagttctacttataaaggaagaaggggatatatagtagtcactatcataattaaattgcataaacaagtaatgaaatcggtataaatttatgttggtagacatttaattgaaagtttattgcttttgactttatagttttctgtattttagttgtgtttaaaaaaaaaagtgggagggttgttcttaaacattttttttttaggcccttgaaaagtctgtcagctccaagtgctgtgtctaatggatacaaaatctctgtggatcatgaggccactaaccagagaaggaa

SEQ ID NO: 8173 - DNA, 374 bp, Homo sapiens
tcttcagaaacatatgaatgcctgttgtgtgccccaggctcagtgctgtgtgatagaaaatattcaccagtctttaaggaacttctaatctttcagggaaagagataaataattagaggttagtataataacaactatgatggagaaaagagcaaagtactgaactagcacagaaaagggggccatgggccgggcacagtggctttcacctgttatctcagcagattgggagacttaggcaggaggattgcttgagcccaggaattttaggctgccgttagctatgataatgccactgcacttcagcctgggtgacagagtgagaccttgtctctaaccaccatcctgtgcctcccacccccgccaaaaaaaaa

SEQ ID NO: 8174 - DNA, 419 bp, Homo sapiens
acaatgattgagagaaagacaaactcctttcctaaaaagacacgttaagcagagggcattaggaaaacagatctttaaaaatatttcatagttatgtggttttgttgtaaagacaagtatgtatttataaaaactcatagctgtggccaggcgcggtggctcatgcctgcaatcccagcactttgggaggccaaggcaggtggatcacgaggtcaggagatcgagaccatcctgactaacatgtgaaaccctgtctccactaaaaacacaaaaaaatttagctgggcgtggtggcgggtgcctgtagtcccagctactctggaggctgaggcaggagaatggcctgaacccggcaggtggagcttgcagtggccgagatcgtgccattgcattctggcctgggcgacacagtgagactc

SEQ ID NO: 8175 - DNA, 512 bp, Homo sapiens
caacatcaaaagctgtaactctgcccttttctcttcgtatccatgtcagacgcagggtaactgggagagctttcaatatcaacagcagctcatcttactgataaacaggcgcagacagaagcagatggtttctaggcacagaaagcagtgggtgaaagtggtacactcccgtttctatcttcagagagtgtaaaatattttatcctgaatgacatgctcctaagttaaaataatatttatttgggtaggcctgctatacaggaaatgttaagataccgaaaacggtacactggaaacaatatgaatcgtgcaacaaaagcgagtgaactctgaagatgagggaagtgagtcgcaccacagacagcagtgggggatagcaactctaacaaagtctccgctcctgcgaagagctcattcaagcacctcccttttaaagggtattcctaataccctttggaagtttcttcttcccttcactcacaatttcccttctctgaggttccaaggatgtg

SEQ ID NO: 8176 - DNA, 353 bp, Homo sapiens
tcgctgtcctctttttacaaataaggaaaatcaggctgagggaggggaaggctgactccttctgactcccatctctcagctcctaccaagatcctagggccttgtgccctccactgctaagcgagatttcctaacttcagcacacaccccagcctggcacgtgggccctggggaggagaatgattgctccatctgcagagacagccctgcggggtggagccgcatgaagttacttgaggtgaacaaggggagtgctcaggcatgaggactttggacttgggaatggatgaagcgggagtggggaggacttgtgctgaggcgcttaatggagagggtcccctgggaatcgcccc

SEQ ID NO: 8177 - DNA, 317 bp, Homo sapiens
acatccccccatatactttattgacttagagacaagatcaccctctgttgctcagccggagtgcagtgtcacaatcacagctcactgcagcctcaacctcctgggttccagtgatccgcccacctcagcctcttgagtagctgggactacaggtgcataccaccacacctggctaattttaaaaaaatttttatttttagtaaagacaagttctcactatactgcccaggttggcctcccaaagtattgggattacaagggtgagccacggtacctggccccatgtactttaagtcatcactaataaaatgtataga

SEQ ID NO: 8178 - DNA, 386 bp, Homo sapiens
aaagatagatgaaggtcagtctttgtctctgctccctcaatctgctggaatctgcctccgcccaagaggtcattaccataagcaatttggtgaatatctgcacatatacatgaatgtgcacatgttttattctttacacaaatgaaaacatatgctatagactgttctgtagcttctttttcatataacaaaacgtcaataagtttccagttcagcttatgttttgttgtaactgcatagtatttactagtatttcattatacaaatgtattagaatttagtaaacagactaaaaaaggttacatcctttttctaaacatccttttttctttctttctttcttgctataataaatacttttgtataaacacttctgtgcatttgta

SEQ ID NO: 8179 - DNA, 466 bp, Homo sapiens
tacatctgttcataatcgaaaagtgataaagtttttgcatatgccacaattaacaccacccacaagcacaaaaaagttaggatgaaaatgttcttccaagaatatggtggaataattgtagcctattgaaaattcataaatgaaaattggagtattgtagacagcattcttgaatcacatgtttgtttctgtgtgtaatactgatgactgtcttaaaatttctaacttccaaataaatcatactccactggattataagggcttcaagtgtgggggctgtctcactttcataagcccagtgtcttgcgcattgtctgaaacacagtagatgttttgataaacgtttgggccaggcttgggggcttacacctgtaatcccaacactttaggaggctgaggctggaggatggcttgtgcccaagagtttgagaccagcctgggtaacatagtgagaccctatctctac

SEQ ID NO: 8180 - DNA, 1302 bp, Homo sapiens
cgcggacaaggccaggctagccttgagctccgtcgggcagggcgccgggattggtgtccggcagagcgtgagccagcggtgcgaagtcggcgagcgggagtgaaagaagaaaagctagagagcgaaggcaaagccgaggagagagggccgcggtcggcgaaggaatctgactgcacggttgcgtcgctcacttccggaggctccctcaggcgggcggctccctagtggctaaaggcaaagcattccggggcgcggcgcatgaagttgagcttcgtccctgctagccgccgctttctccccaaaaatacatcctagccttaatgtttatgcctccattgccccagttcttatctgttttgctcaatgtctcatagctacaagaaggcaatttctgacgaagccctccgtcccttccaaatggattattttggcgggcttccacccggacagtatgccacccgaatgactggacaagtgcacgggagcggctgtcatttgcggagtgcgccttgcgatctaggcgcctcacagcgcaaattatccagtaatttctctgaaatcgatgctggtttgttttcccaaggcaaatcagcagcttatacagacattggggccacaaagccggtggaacaacgggagacggcttcctgagtgtcaggtcctccaagatgagcttaaacttcgggtggtgggcaggctcggtaggcgggaaaggcccgtgtccagatgaatgcagtccatgtttatattgatgaaagacacgtataccatttggtccagctcaaccattcttaacaagtgctggctgtgagcactggtgtgtgtgtgcctgcgtgcaaccagcaatgtaagtgatgaccagctgcatgatgccttaatttgagtggacaaagtcggtcaagaaccactttcaggcttctgggtctccaagtctttgtctccctgtatccaaacgaggcattccaagtttgacagcatggaacattgcatgtccgaaataccaaccgtgaaactgggtaaaaagcttcaggaggtgatattgatgtgtatagtttaggaaataaaacccaatacttacttcaaagaacgtaatttgtggctttttagagagaaggatactttgacagttttcatttgtcgtctacatgtatatggtacgtttcattctgccttttaattaatttggtattttactatgaaaactactttgtattaataaaataatgtatttccaatgttataagttgtgttataacagtttcaaaagccaaataaacaagatgcattttgaaaaaaaaaatt

SEQ ID NO: 8181 - DNA, 5123 bp, Homo sapiens
cgggcccctcgccactaccgccgccgccgccgccgtgagtcccgcggagccgcgcgcgcccccggctgggccgagccgctggccgacgagcggagcctcaggagccggcggggacgccatgcgagccagcgtctcccttctctcctggacagaaggccgtgtcctgggacttctctgatggcgagaggctgcggctgtaccaggaagaaacatattgccgagtggatgccgccgcgcagcgtgtttgcttgaggcagaagcttcagcatctgctgggataactggaggaagaaatatgaagccttagcggctttacccgggaagcgagtttcgagatggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacct

SEQ ID NO: 8182 - DNA, 481 bp, Homo sapiens
cagttccgtctgtcgcattgatgttggctggttctgctctcaaaggcgccggctctgtagtgatgtcagcgccgtgtgacttgaggaggagaccccactgctgcgcgtctcccttctctcctggacagaaggccgtgtcctgggacttctctgatggcgagaggctgcggctgtaccagcgaatccactttctgttgccacccgtggaacgttctcactcttccaagaagccaggctagcagctcccccaccccagcagccgcgggacagagcccaggttgggtggtgtgtacacaaaggagggattgttctcacgtcgccctgcgacgagatggggatggacccgcggttagaggtcaccctccctggggcgtcaggggagcatttgtccttgaaacacgctggcaaaaaatgttccaaggaagcctcagctggtgtttgtgaggaagagctggattaaatggtgttctggtaaaatgtt

SEQ ID NO: 8183 - DNA, 2985 bp, Homo sapiens
taaaacacaggttgccctaatctaaaagcccctattccccgggggccaaaaacggggaaggggttttcctccaaaggaagcaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttagggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaataaaattctacaaaagttgcagtaaattttatttggatattttaacctgttaagtgtgtgtgtgttttctgtacccaaccagactttaaataaaacaaacatgaaacct

SEQ ID NO: 8184 - DNA, 337 bp, Homo sapiens
gtcacagcatttcaggggcaaagtagcaaagaaaaatcctctaaatggaacattataaaaggtcagcagagcaagacaaaaatatatattgctgtccatgttataaaagctgtcaaaaatccaaggcagcgtcactaagaagcctctttctaaaggcagatgcctggagtgagaataaaacattaactcattaacctttttattataaacatgtttattaatttcttaagagagaagggagttctatgagggaattggacttatgacaaataagttgtgatgagttcaatagaattgaaaaaagtgaaacacttctaattcacttagcaagacctta

SEQ ID NO: 8185 - DNA, 654 bp, Homo sapiens
caaacagaaagcccagactcgatgaatttatcttttcttcaaagtagagaaagggtagctcttttcttcccaggaaattgtttatccatttaataatttttaaaaatcactggagttgggtgtggtggctcatgcctggtaatctcagcactttgagaggccgaagtgggcagatcacttgagctcaggagttcgagaccagcctgggcaacatagtgaaaccctgtctatacagaaaatacaaaaattagctgggtgtggtggcatgcaactgttgtcctagctactctggagcctgaggtgggaggatcacttgagcctggaaggcggaggttgcagtgagccatgatcgcaccactgcactccagcctggatgacagagtgataccctgtctaaaaaaaaaaaaataactgggataaaacaactcgaaagacccttataaagattttacccgtaactctgtagagcaaataacttcctgctttaggcaaagctctttgtgtgtaagttcgattggaagaggagggctggtggggggagattctctactttggtcatgagattaacattaaaagtttgaggaaggttgctctatatattggctgcctgtttctaagactgaaaataaaagcacagtaaaatatcaacaagta

SEQ ID NO: 8186 - DNA, 369 bp, Homo sapiens
ccgttctctggcggacggggctgtggaccagttcagccgcccctccccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccccgtcccgcccgcgcatgtcggggaagctctgctccggcagccctcggggtggtgctgggaggtcgcgcagaactgaaggggctaggttcgagaacgccgaggatggggtctgcgaccgcctccccgcacctagttctccgccccacctgcggcgtctgcaggtcctacaaggcgca

SEQ ID NO: 8187 - DNA, 736 bp, Homo sapiens
gcactgtttcaaacttagctgctgctattgctgctgtttggtaataaattctagtccccttttgacttcgatcaaaatctgatgccctaactcagctagaatgagttttcccattgcccatgtgtctatttttgttaaacggtggaccctaatcaaccgaggaggtgtttgttatagaaaaccaatgactaggaatcaccttctcagatacagaatatgaggccccaaggggtgaggggaggtgtccatggttactagacctgggggtctcctgacttctaggctgcgagggaaaatatcacagagtatgctctgattcctagagggccagaggggctcctttgtgatcccaagttctggttcaccttctatatggagttgtgttctggtcttaagggacttacccttccattccatcactttctgccatcaaaactttcctttctgttttctaagacaatatcaatggctgtggatattgaacaattgtctgataaaagtgatttttgacattaaggatctaagtgctcatatttgagagtctgatctagtgaccctcatgaataacaatcacaccttacttagtactgggattttccctttacagttgatgtttacttacatgattgacctgcgtaacagtttaaaacaggtaggaccacgaggtcaggagattgagaccatcctgacaaatatggtgaaaccctgtctctactaaaaatacaaaaaaacaaaa

SEQ ID NO: 8188 - DNA, 397 bp, Homo sapiens
aatttgctcgagcatcaagaccctgataataaagacagaaaaatgctgaaacagcagaattttaaaccaagttcccctctgcagcacaagaaactcaggtaagtttccagtgtccaaagcctacactcacaaacacaaacacgaagccctccctttgcaaccctcaagtacccagaacctgctgaagaaaaccatctttcaccaccttttgttaaggttcctcagtattagtggaaaagctttattctcacaaagatatccaacaatgctaatttttacatggcatgttatttccttaggcaagattaatagaaaacctgaaaaattcgcaacaagcacacaaagactagcttctgtaacacaacctgaccccacccatatcacaccattttagaag

SEQ ID NO: 8189 - DNA, 424 bp, Homo sapiens
attaaaggtttctgggtttaatatgctttaacacagttaagattaattttatttttatatttttttgagacggatatcactctgtcacacaggctggagtgcaatggtgtggtctcggctcactgccagctccacctcccgggttcaagtgattctcccgcctcagcctcttgagtagctgggattacaggcatgcaccaccacacctggctaatttttgtatttttagtagagacggggtttcaccatgttggccaggctggtctcgaactcctgacctcttgatttgcccgcctcagcctcccaaagtgctgggattacaggcatgagccaccgcgcctggcccagattatttttatttttaactcctgtgttttctcctaatatttgtatagtttatttcgctgggggcaagggttgaagg

SEQ ID NO: 8190 - DNA, 121 bp, Homo sapiens
tttctttttttaacagcaatataatgaatgcattcaaaactttgagctgtgggctgtacttagatgtagacatgcttttctgatgaaatataattatatactctgaggaataagatgtcta

SEQ ID NO: 8191 - DNA, 716 bp, Homo sapiens
tgtagggggatccctaacctacacagattctggttgccatggtctaattgctaccccagtggcaggaataatagaacaggcatcatagtccataggcacctaggcttccaagcagttcacagattttggtcatgtgccaggtctctagttagtacttcactggcaagtgctggcttgaattaataaaagcagcattgaaatatctgtgggttttgtctttagcttccacttcactcagctatttttttgtttttgtagtatctttcaactgattgtgtggcatgaattcatttagataccacaactcagaatggcattccaaaggcaagagtggaaatgtctcaacttggtaaataaaaatagcaaccagattcagccatcagacggtaattagtggagctggaagctagccattccaaggactaactatccttgataaagacgccaaggctctttagctttgcatgctcaatctctccttttctgttttcttccttcctttactcagatttttctattctatttcactcaagtaccatctgttattccttttcacacacttttcagacccttcttttattcctgcccattctgcatacctcatcgttaaaaggcgggtaattctacaaagattccaattagtgtattgtttgacggctgatcaggttttcccccttttaagatgaaccactgaataaatggtgtaaagaatgtaa

SEQ ID NO: 8192 - DNA, 1740 bp, Homo sapiens
gcattgtggttcagtggtagaattctcgcctgccacgcgggaggcccgggttcgtttcccggccaatgcaccagaagatgtagttaatagaatttaatcttttctaagtgcacattgaagttgccttttatgttcatattatgttcatattttatttgaaaaatctatagcatttttattgtgctgaaagcattaatatttgcagcactttgtgagacaggcaaaattatctttttgctgacttggaaactgcaagagttaaaagacttgcttggaatcacacatggcagatagaggataaggaaaagatggcctttcagttcctcatcagtaccttgctactacagtgtctgcagattggtgtcttacattcagctatgatttgttcgccaaggtaccgtgtcttcttactgaagttgttttggctggcgcttgcctccgttcagagggaactgagttacctaactttatgatgctaagagccaggaaggtactgggatctgggatgctaggcacctaaccagtctagactgaactccatactaagctgtttttctgtgttaaggcatcaagagtagatggtggtcctgattttctgagatatattatctctgaattatctacataaataactgaaacttttatgtaattttaaaactagtcaatcatgttaccacccttttgaggggcaccaaatttgagacccttacccccaatttattaattaatagctgttttaatcacctaatagctgatcacctaatgactaacagtcattttcatcctggaaaatgggaactaactttgactttgaaaagtgctgttattaaatgtgtgattcataagaactgaacatattttctttattattttccttcaggattcaactttaattgactccaaatgatgttatggtcattctgtttttctgatacgagaatagattgttctgagaacctagaatattcattgcctttatgaatctagaattgactttaaatttaggttattgtgtttgtcatttgcgctaaaaaaaaaattgccctggggaataccaaacttctcggtacattcgtgtggtgtgaaagtcaaaattgccaattaggttctattttgaccaaatagttgaatgttgtagacagttgtaaattttgaacctgttctaatttgccttttgccagatggcgcatttaactttgtggcatatcatcgactttcaaggaaagatttacttttcatcagattaaagttgaggaaggattttctttctaaatactgaggctctgaatttcccaagttggataccccagacagctagagtgatcttaaaagtgactctgagagttgacttaggaagtgtagacatttatccaaaatctgtatttactcctgacttacattacaaatacagagttttatttttaaagaaaatttcaataaaaagcaccatttaattaaaatctactcaccatcaaactttttaaaaagaacataagccaatgtcaggagttggagaccagcctggccaacatagtgaaacgctgtctctactagaaaaaaaaaagaaatacaaaaattagctgggcatggtggtgcgtgcctgtagttccagctccttgggaggctgaggcagtagaatcgcttgaacccgggaggcggaggttgcagtgagcccagatcatgcccgtgcactccagcctgggcaacagagagagactacgtctcaaaaaaaagaaaaaa

SEQ ID NO: 8193 - DNA, 464 bp, Homo sapiens
gtcaactctgtcaaccaagggcatcaatggccacgtgtgtggttttctccgatttatccaacttctttgcactgagttcttattcaagtgaagtattccggtcttgtgacttgtacttcaggtcaggaggacgtcctgctgcacgctcaggcggtcgctcctcctttccacaagacccaggcccgcaccgttcgccccggggctcccatggcccccgacctccagtctccagcaacgatggatccccacagaccaggcagggggcgaagggcgcacacccacctcccgggagtcagtgggaataaccccgggcgctcccaggatacgtcccacacccggagccgcacgggcccatccccgccaggtctgggcaggcagccggagcccgggaccccgcctcccccgcacctagggtcccggccgagctcgaccgctgaggtcccgttcccactcccactcccagc

SEQ ID NO: 8194 - DNA, 1256 bp, Homo sapiens
cgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcgcctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgca

SEQ ID NO: 8195 - DNA, 1295 bp, Homo sapiens
cgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcgcctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgcaaaaaaaacacaaaaaaacaaaacaaaagcaaacaaaaaa

SEQ ID NO: 8196 - DNA, 1181 bp, Homo sapiens
cgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcgcctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgca

SEQ ID NO: 8197 - DNA, 901 bp, Homo sapiens
cgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcgcctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgca

SEQ ID NO: 8198 - DNA, 961 bp, Homo sapiens
actatacggctaggtagcgaggcctggtgttgagcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgca

SEQ ID NO: 8199 - DNA, 1617 bp, Homo sapiens
taagtgcaaggacaacaaaagtattataagggatgttaaaaaggcttgtgagtccaatagaggttaacaaaaaaggaaagtggtaagaaaaataatgaatgttacatttgtgatagaatgaatcatttaacagaaggacaaagagtgaactgtcagcagggagatgaggaacagtcactgacgaaatggaaaaacgtgtgtctgtgggctgtaggatcagcgtatgtgctcagaggcttgttggcttttggtaattcagctgaagagtaggaaattgtaactccagagccaagtatagtaaaagggccgctggagacattttgggaaaccatgagtggggctgtaggttcatggtcctttcaagcctatacgacctcagagtgagaggggtggtggcatagttggaatctgtaggttccaagacatttctgtagttctttcaaagtttatcagggatggtatctgccagaacagtttcagtatagatgtgactcacctatttttgaaaaaaatgtttgctacagtgtaaagaaaggaggattgtggacattttaaagttctgaagaattggttaactcctatttggtagaaatgaatcttgagactgtaagcttaactcccatccctccctttagcaattttggacttttgaataaatatagttacaaattgccttttggaatttactgtgttgacaagtaattgagcttctgtacatgttaagtataagatatggagaaggatgctggtgtttgtgtttatgtgtgtgtgtgtgtgtatgttttttttttttttaaatgacatgcacatttgagtggtagactgtttatattttgatttttcttccagggcagaaattggtacctatatacacacaccttgctttgcttatagactgattttgaatccagtttcagaggttcagcattcatatgggtccagctgaatggtgatattcccttcaacactcatgtgttctgactgtgtttgcttttctaagggctaacttacagtctgcctgacacacagtgcctggttctttagcattatggagcctgttccttgtatatggtttccttctaagtgacagggctgagctaactggaatttaccaagatacctttggacgtactacattttcactcatagagtagttggtagcatttttttcttcttcttttttattctcttttctcttcttttaaaattaataggagcagagcagaaaatttatcccaattaggtagaagttaaattctgtttagaatttataaaatgttaggagttcaactgtgccaggtatgggtggctcacactgtaatgccaagactttgggaggctgaggtgggaggattgcttgaagccaggagtttgagactagcctggacagtgtagcaagaccgggtctctgcaaaaaaacaaacaaacaaacaaaaaaaaacattaaaaaattagccgggcatggtggcacatacttgtagtcccagcaattctggaggctgaggcagggggattgcttgagcttcctagacttgagcctagaaattcaaggctgcagtgagctatgattgagccactatattccagcagcctaggtgacgagcacgaccctgtctc

SEQ ID NO: 8200 - DNA, 500 bp, Homo sapiens
cattcctttggagtcagaactgaaatgttcacaaggagaaaagggcaactccacctcagcagaggaacacagcagaaaatgggtttctgactggctgttccctagacatgcttgttttgtcatcctcattccctgccccacttgcgtgcccgccccaccccaatcaaagttcctgtaggaatacctcaaagatcccttgtcaacagccagctacccatcaaggctacttgatgatcaaatcagcctttcctaggccttttcctaaaggattttaatctctgtccttgttcttccctggatttttttccaccactctttggcttaataaatgcctttccagaaggcttcagcgcggctggaagtatacttgaacggcaattctaagtccttattagctctatagtgatcaggtgaaggaataattgatctcaatcaggaacacctggttttataattgcacaaatgattataattcaataataaaagtcaatttaactaac

SEQ ID NO: 8201 - DNA, 573 bp, Homo sapiens
cattcctttggagtcagaactgaaatgttcacaaggagaaaagggcaactccacctcagcagaggaacacagcagaaaatgggtttctgactggctgttccctagacatgcttgttttgtcatcctcattccctgccccacttgcgtgcccgccccaccccaatcaaagttcctgtaggaatacctcaaagatcccttgtcaacagccagctacccatcaaggctacttgatgatcaaatcagcctttcctaggccttttcctaaaggattttaatctctgtccttgttcttccctggatttttttccaccactctttggcttaataaatgcctttccagaaggcttcagcgcggctggaagtatacttgaacggcaattctaagtccttattagctctatagtgatcaggtgaaggaataattgatctcaatcaggaacacctggttttataattgcacaaatgattataattcaataataaaagtcaatttaactaacttaattcagattgctttaacctctcgcagacagttaaaaaatgaacaagcaaacaggaaagggaaaagaaaag

SEQ ID NO: 8202 - DNA, 300 bp, Homo sapiens
ggagatggcaagggagggatcctgcttggatgaaaagtctttagggaccatctcaggttactctcaggtgccctctgagttagtgtgttctaagtaaggggttctaagcctcctattgtggctcatccctgacagtgtcagcaccagctagctcccctaaccccacagctcagggtccactttgcttctgcatcctgcatgttccttttcctgctgaaaagcagattccccagcgagcagcagaatcctgtttctccctgtaggcccctctgctccttatgagtggtgttttgtgggatt

SEQ ID NO: 8203 - DNA, 388 bp, Homo sapiens
gtgaagggcattgccaaagtggaatcagtaaggcttggcagttgaccttgtttgttggagagaagggataagattttaaagctacatgtctgaaagaatgatgctgctgattgaaataaaggaagaaaggatgcatttcgggctccaacctgtcctaggaaggcctagacctcaaacaccaacacctccatgcatttcctctttggctactatgtcttttccctgacttctgcctctccagctctctgggctgctgcttccacctgttcatctgacttagaccctccctgctgggtccttgttcacctactcatttggtgcttcgtctgccatcagtacctccattgcagctggtgggatgtcagtcaccatctcttatatttgcttc

SEQ ID NO: 8204 - DNA, 372 bp, Homo sapiens
gctgatgataagctggtggagagtctgttaactcaaggcctgattctaatgaatttgggattccttgctgaaaaaaagactgggctgggtgtggtggctcatgcctgtaatcccagcactctgggaggctgaggcgggcggatcacctgaggtcagagtttgagaccatcctggccaatatggcgaaaccccgtctctactaaaaatacaaaaaattagccgggcctggtggcgggcgcctataatcccaactactagggaggctgaggcaggagaatcacttgaacgcgggatgcagaggttgcagtgagccgagattgcgccattccactccagcctgggcaacaagagcgaaactccacctcaaaaaaa

SEQ ID NO: 8205 - DNA, 388 bp, Homo sapiens
tcagaacaaagttttaatttctctccttactagaaatgatggaggataggaatctcaaatgttgacattttaacacatttacatatattatattatatacatatttctgctattccataggtaagagttaagcttaaaattagcccagcaggattagcggtttagttctctttttaacatattttgcagatgctaaggttttggcacggaaagagaaaaatttctaacttcccatcccagttacagattaagtatgtaaaatcttcagatactctttaaaaaactgtttagagtaatagggcttttcattttgtttttaggatttttctttggattcaagtacaggatttaatatattaaattttatcttactagatttggcccattc

SEQ ID NO: 8206 - DNA, 437 bp, Homo sapiens
ccatccttccaaaggctcaggaggagtctgttcctttgcctctcccagattctggtggatgcccacgttgcttgtttcaaggtgctcagcaggcagcctcatccccgccccgcctccacttccatctcgcgcctctctcgaacctcctgcctcgctctgtcacttacgtggttcttgtacttgctttgggcccccaggatcccaggtccaggatgttcccacctcaaaatcctgaatttaatcgtgtttgccaattcttctttttgccatgtaaggtagtggatttgcaggctctgggggttgggacgtgggcgccggagattctcattgtctcatttgtaaggtgcattgctcctcaccaacatctgcagaagcctgggtcccccacagtgtccctccaaagtccagaatcccatccaatcaggcatgggggattg

SEQ ID NO: 8207 - DNA, 374 bp, Homo sapiens
caaagtccagaaataaacatgcatatgtaatgtatatgtgtgtatgagttaaaagttaaaatgaaattattagattgttttttaatataaaaaatatgccacaagttcaacactataatatttatatttgtcgactgactagttaatatcttttaaccatgatgaaaaaaataatattcagcaagaaaagtaagaaggattgaaataaaaattatccatcttgaaagtggaaaccatgacttggcatatgaaagaaataacatgttattttttgctactagttacacagtataatttttagcagtgttctcatcccagatgacagaaatcaccatcacaccctaaataacaaacagcatggactgtggatgaaa

SEQ ID NO: 8208 - DNA, 428 bp, Homo sapiens
gcctccagctgagaaagcaaagccaactcacagttccttggctgtcccgcggagcctgcggtggcaaaccacctccttcagaagggtctgtggattctcctggcttttctgtccttgccggagtcccactgctcccgaacacatgccctgaggcagcgtgcctgcacaaccagcttccatctgaacgcttcagacatgcgctgcattcagggcagggacttttcttggacagagaagctgagaagtatcagataaagatgacctgcatgtactggaaaataatctgtggtttatatgtaggcggatggaagcaaaccagggtaatatacatttagaggcagagggctctcacaatatcctcttcaaaaaacattaggatgaaaacagttgcagaacatttctagtaaaatatatcattaaaacttagg

SEQ ID NO: 8209 - DNA, 383 bp, Homo sapiens
gtatattcaagagacagacgctgtctcagaggtcattagggatggctctgggcctatcagctggtgtctgcaactagagatccaagcaatcccttccaactgggatattgtccaccagggagttgtctggtacacccaaggtctgccagccgtctttttgtttggctgcctctcttggatgacacccttgaaaactggaatccaagttacaaatgatatcttttaatttatctcaaatatctgcttgctactatattaaactggggacatacaaacccacccctgccccccatttccttgctaggctatataaaacttaaacttcaccttcctctctccacaccaaagtgtagccaaggctaagatgttaaaatgaatatgtt

SEQ ID NO: 8210 - DNA, 643 bp, Homo sapiens
gacactcacaggtttgaccccaaggttaagctttgcatttcgaccttgtaagccatgtactgtggtgcccatctggacagctgagttttagcagatgctggtgaccatctgctgaagacatctagcatgctctctatgctactggaatgtacgaacctgtctttctgagtcatttcaaaggacagctcattttccaggttttatccagcgctgtgggctgccccagcatcatagtttctgtaaagaatccttgtcttgtgttacctatacccccacttcaagatattcctactcctacaacggagcgctgattgaatagtactcccactgtgtgaacccagagctgctcaggtttcgtcttgcccctgctttaacagccccactttcctcatgcagacaggagctgtggtagttaattagccctcacaagctggataattaattttcagtaagtggctcagtcttccaattttaaaggggtttaatgaaatcttagaggtaaatgaaatgcttaaaatctgtgcccatttaatagaattctctatcaataggtacctgcctctagcccatctccatggggtccttttgtcctttgactcaacaagtcacacaagaatctctggtggagtgagtctctgtctcc

SEQ ID NO: 8211 - DNA, 434 bp, Homo sapiens
aaacagaattgaggaaatgcaaagtgaagaaattgtagctgtcaggaacaagagaagagggatgggaaacctgctactgaggtttggaggtattcctctggagttttcacttataccattctctcatgcccaggaagctgctcatcaccaaaccacaagtcttcctctaactcagtcacaactaagcttctatccagacactgatgatactgtaactgttttgttgtgcttctgattagttgccctgtcaaccataagcagcctataaacagggcctggctccatccttgttacttccccattgcactgaattcagtatttttccctcaaggtagatagttgtggggcagcatccctaaaaatatctagttatattatggcatccagtaaatgtttccttaattacttacctccattaacaagctttatgcaaa

SEQ ID NO: 8212 - DNA, 732 bp, Homo sapiens
ccgaagtttagaaaccagcttattgccaaagggaaaaaggatagcccaaaggacaagaaaacacttctcactatgaattggtttggaagtaacttcttcaggtgtcctgaggatctttccttactcaacatatactcacctctgttgtcacacatgtcatctgaagatgaacattttatttccaacttgagaggccatgtaccagccagcgctgtggtgaagcagcctgttcggggagccagtggcaggacgacaatcacagcaattgtccagactggcgggggctggagcaccggtctcttcagtgtctgcagagataggagaatttgtttctgtggtctattctgtcctatgtgtcttgagtgtgacatcgccaggcattatggagagtgtctttgttggccgttgttacctgggtccacctttgcactgagaattggcaccagggagagacataaaatacagggcacactgtgtgaagactggctggcggtgcactgctgttgggctttttccatctgccaggtggcccgggaactcaagatgaggacctcccaagtctatgaaatctgtgcagtcccaatgactaaggacaccctggtttgacagcaagataactcctcctccttactccccaacaccctcctctcaaacctctcagtggaacaattgctttttcctaagtttttactgaaatggtatgaaaataaatgatttcccccctaaaaactc

SEQ ID NO: 8213 - DNA, 300 bp, Homo sapiens
gggcagcttattcataaggaagcccctcgtacttcatggtaaaccaactagaaagatacagctcctgacttttccaaacctaacaaaagaaaaaaacactgaggtttttcttcactgtgtcagtgaaaaagaagactattacctcgacctggtaatatgcagcttatagagatgtttttcacctatagcatctccttgcactatcaattattttacctgttgtttctcaattataattactgtaaggcacttcaaaaaaagagatttttttaaaaagcagaaatggaaatatattaattt

SEQ ID NO: 8214 - DNA, 390 bp, Homo sapiens
accagttttagtggcagtgggaaatgcctggttcctccttgtcattacctttttggtttcaatgcatctttacaaagatgattcatgatcttgtgcttggctctgactgtggaccatagatagtgctatgtccagtctcctggcgccgtcttcctcacgtactgctgaccttctgtggcaggtgaacccagcactacacatcactcttgtcagaggggtgggagctcccattacacctccttctgtgagcagctttcaaaaatacttctcctggaaacaaaacaagtggtggctgctttataagaatgcagtgcaagatctaaagcgttccttttctttcttttaagctttagttaaattaataaacattggttaaatgaatgacctgtg

SEQ ID NO: 8215 - DNA, 560 bp, Homo sapiens
cactaacacacatgtaagtgcctggcacagtaaaaactcatcagtgatagctgccgtcaccatcaccgccattattcatcattgattcatgcttaggctcacgggtccttagctacaaagcttttggtatgtgagtactgcacatgtgtaatccacgctgttagaacaaggctcctttttgttacaggaatgggggtaccactgctaagatagtgtgactagaagttagctcattctaagactttttttggttattgagagaaaaatcatagaaagttggtaccatcagggaccacagggtgctgtttccacctgtatcccccatactcactaactgaggctcccaagggtagatagcttgtcaaggccccacagttagttcacagtcaagttgctattagaattcagatctcattttcatctgctcccatttcattttattccatggatttacttgccttggagatttggaaggggaagaaaataattggcagagaccatgatggttttggtcctgggtgtggctgtgtcccacaccggtgctcatgtcggggtggagc

SEQ ID NO: 8216 - DNA, 442 bp, Homo sapiens
gactcttactataattacattaggaggtgggtggggggcagtaactaggtttagttgaggtcatgagggtggagcccacacaatgggattagtgcccttggaagaggaaacacctgagctgtttctctccctgtcatgtaaggatacagtgagaagtcagccatttacgagccaggaagagggtcctcaccaagaacttaatctgccagtacattgattttggacttcgcagctttcagtactatgagaaataaacttccattgtttaagccacccagtctatggtattttgttatagcagcccaagcagattaaggtatccactcttcatgttctgttccaactaaccaatctcagtgggtctcttgaccacccagtgttcagcagacaacaagtgctcacttacagccctgtcaaatttaccatcccctaaggacaaaaa

SEQ ID NO: 8217 - DNA, 847 bp, Homo sapiens
cagttgtctgtgattctcaatatagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaacagcgtagaaacgaccccatcattggccacaaaacgggcaaagatgcccatgccacccacctgcagagcaccgaggcgtctgtgccggccaagtcagggcccagtggtccagacaatgtacaaagcctgcccctgtggcccttgccaaagggccagatgtcaagagagaagcaaccagatccggagtcggcccctagccagaagctcaccggaatagcccagccgaagaaaaaggtcaaggtttctatcacatccccgtcttctccagaacttgtgtctccagaggagcacgccgacttccagcagcttcctgctgctagtcgatgcagcagtacaaagggctgccgagctggagctagagaagaagcaagagcctaatccatgattgatgatgttccaaaaacccaagtagtcagtcccttatgtactgtggtaaacctgtttatgttcaccccaaaa

SEQ ID NO: 8218 - DNA, 399 bp, Homo sapiens
agtagctgggactacaggtatgtgccaccacgcctggctaattttttttattttttgtagagatggggttttgccatgttgcccagtctggtcttgaactcctgagccaagtgatcctcccacctcagccccccaaagtgctgggattacatgtgtgagtcaccgcgcccaactcactttaatctttttaccctcctaatttatagtaacctgtactgactatatctctaatatcccaacttctcctggattctctgctctcaatcacttgaactttcatctcacaggaaccgtgagcagccaaggtggacctacatcagtcaaaatgctcctgtctgcaagaaataatactctatttagactatcttaaactaatatattaacctctcattgtagagc

SEQ ID NO: 8219 - DNA, 621 bp, Homo sapiens
actttttcttcccttgcattttagaataggctggtatctcatttgaacgggggagcagacttgatctcaaatgaagctgtgcccaggagccaggcttagcatattgagatttttatagataccttaaaaaataaaatatttaaacctctcttttcttcctttttctatgaaataggttttttctctagtttacaaatgacatgaaaataggttttatttgtgttttatctgctttattttttgatgcttagacaacagttagacttactgagctcctaaaaaaacgaggaagaagtccttatttgtgaaaagcactttatgagtaattgtatagacagtatgtggctgcgtcactgatcatcttgtaagggtgtaacagtcttgtctgtaaagtggctgcagtgccttctgtagtgtgttttatttttggtagggagaggtgaagccttctgaaaaatttgagagcaactacagaggattgtttgtaactgtgtagtattcctgatggacttttttcatcgttagagtcaaggacctagacttttgccactgaaataatattgaccaaaaaaatagtttataaaagggatttgtgaatagaaaattcagtgtgatcatttg

SEQ ID NO: 8220 - DNA, 421 bp, Homo sapiens
ccatatgtaggttcctttgaaacaatagtgctcactagggaccccagagggaagctcaggttaaggtccaggtatgaatgggtggatatacgtaaaggccaaaacagcacagcataaagcagagattctcaatgctggctgtagactggcataactggggagcttccccagaaattctaacttaattctgtctccaatgggcactgggcattggtgttgcttagtactcccaggtaattctaacctgcagccagtgttgggaagcactgatgtagaggctaagagcttggggcggggcgtggtggctcacacctgtaatcccagcactttgggaggcataggccgcgactcccctagcggtcaggcattagagcctgactggcacaaacgatcgagacaaccgcatctctcaaaacacaac

SEQ ID NO: 8221 - DNA, 590 bp, Homo sapiens
ccatatgtaggttcctttgaaacaatagtgctcactagggaccccagagggaagctcaggttaaggtccaggtatgaatgggtggatatacgtaaaggccaaaacagcacagcataaagcagagattctcaatgctggctgtagactggcataactggggagcttccccagaaattctaacttaattctgtctccaatgggcactgggcattggtgttgcttagtactcccaggtaattctaacctgcagccagtgttgggaagcactgatgtagaggctaagagcttggggcggggcgtggtggctcacacctgtaatcccagcactttgggaggcataggcaggtggatcacctgaggtcaggagttcgaggccagcctggccaacgtggtgaaacgctgtctctactaaaaaaaaaaaaaaaaatacaaaagttagctgggcgtggtggcaggtgcctgcagtcgccgctactcgagaggctgaggcaagagaatcccttgaacccgggaggcggagattgcagtgagtcgagatcgcgtcattgcactccagcctgagcgacagagtgagacttcatctcaaaaaa

SEQ ID NO: 8222 - DNA, 418 bp, Homo sapiens
aatatgattgatgatcagttgagcttgaccagagtccttgtatgtaatggagaaaagatttattgaaaaacaactcagaaagcactttattgatttccctagattattagttggtattaattattcaaaactcactgaacttcccggcaaatgtctcaatcacttaaccgaaaatttgtgcattctaataaacgtgataaataaagctattatagataggtgcttgaatttgttgaccatgcatttgttagaatatctatgattgctaattaagttagaactgtatagattatgatttgttgcaaatgtgatgtatctttggttgtatattttcagactaattacatcaaacaacatttaactgttttgccccagattattttataattaaatattccaatttctgttaaaaaaaaaa

SEQ ID NO: 8223 - DNA, 367 bp, Homo sapiens
gaacatatgttaatttgataaaaataaagataagtttaaaaacaaatatatcaagtaaaaatattccttagtcagtgccttaggtgagaggaatacaaagatgaataaagaccatctccaacttaaaaatattacagtctaatacaacataggacatagccaggaagatttttttaattgctttttaattgcttgttagtgtttatctctttccaggaaaatagaaaggagttctgactaactgaattttcttttattccaaagtatttttattttaatttgtgtgggtacatagtaggtgtatatatttataggggtacattagatgttttgatacaggcatgtaatgtgtaataatcacatcatg

SEQ ID NO: 8224 - DNA, 389 bp, Homo sapiens
ttttttttttgcaaataatactttactgaaaaattacctagagtaaaatgcataaagcttaagtgtatagctcagtgaatttttacaactaaagtagtccccccttattcttgcggatacgttccaagatccctagtggatgcctgaaaccttgaatagtaccgaactctgcaggggccctcaatccctgggctgccaatcagtacaggtctgtggcctggtaggagggaggccgcagagcaagaagtgagcatccagcaagctttacctcctgagctccactccctgtccggtcagctgtggcattcaattttcataggcgtgcgaaccctattgtgaactgtgcatgggaaggatctaggttgggtgctccttatgagaatctagct

SEQ ID NO: 8225 - DNA, 423 bp, Homo sapiens
atctccgcctcacaggttcaagtgattctcctgcctcagcctcccaagtagctgggattacaggcatgcgccaacctgctcggctaattttgtatttttagtagagatggggtttctccatgttggtcaggctggcctcaaactcccgacttcaagtgatccaacctcctcggcctcccgaagtgttgggattacaggcgtgagtcactgcgcccggcctgagtttgtatagttctttatgtattttggatacaagtcctttatcagatgtgatttgcaaataccttctcactgtttgtggcttgtcttttcgttgcctcaacagtgtcctccaaagagcagagattcttaattttgagaaagttcaattcgtcattttttccctttttttcttttttaattttttttttcagtcaggatctc

SEQ ID NO: 8226 - DNA, 725 bp, Homo sapiens
ctttttgaacagcgaaagagagacttttaatgacagtcttgcaagatcaggtgtctggagtgcaggtacacctgggacagtttcaacaaactatttcttccctagtgtgcaagtccctcccccaattcctcattagctgagtactacggggttatagtcttcctgggcatcgcctattggtagttgtattaagacttcaagtatgttctttagggtctttttgctgcattttttgctgcattttgttgcagccacccataatacatggcgactgtctcaagactctgagcatttgacttatggccctagtgactgcacttaggtgatggcaagctagcccaaactaaattctttgatgaggtggggaggggggtcattgagggggccctgaccagtaggctcctggacactgggtcaaagggaaagcaggaaggaggggattgtggcttagtatattttgcttctttatctctttgtttccatgtggcctgcttaaacatattctaaggcacttatgaaaatgaaccttcttcacatgtaggttattttttacacttacctcctctttttctttttaccctttttggtcttattttcacttacatatctttgtttattaactgttctggaagttttttactttcttcattataggaggagaagtttagtttggcttttaataatagtaagtcattctgttgggacattaggggcatttgtttact

SEQ ID NO: 8227 - DNA, 475 bp, Homo sapiens
aactggttggggatacagtgaaaccatatcacatctaaaccagaaatatcacctatgtaaatttcaaatagctaaattaatttctgaacagatttttggtcagatactaccaattcctttgttaatgaagaaacctcttcccatggggtgccaaagtaaaaagacagaatgcataattgccaaaaaatgtaatgattaggagtgatttctctgactatttaaattttatttgcaagatatcattagtctgtgcttatttccatctagcagggtatatggatagactataacccaacatatgtcaaataattttggtgggtagctcatttgaactaatatggaaactcctcgaagacaaaaatgtaataatacattagcaatgtaatgctatcataaattagaaatgaaaaatgttgttctatttttggggtattaatttttcctactgaacatgtacattcattcagaactgtag

SEQ ID NO: 8228 - DNA, 933 bp, Homo sapiens
gacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggtttgggtgggggggggggcggggggctagcttctcacagcaggaggcctttgcccccacagcccctccacgcctgcctcagggcctgagaagccaccacttgcatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcttaaataaataaaagtaagcctaagcaagagattgttc

SEQ ID NO: 8229 - DNA, 366 bp, Homo sapiens
tgccaccacgcctggttaatttttgtattttcagtagagatggggtttcgccatgttggccaggctgatctcgaactcctgacctcaggtgatccacccgcgtcagcctcccaaagtgctggaattacaggtgtgagccactgcttccagcccaaaatatcttaagtagataattgcacgactaatctctgcttttctctcccagcagccttccaaattcatgtctcacagctgacagagttgttcctgccttcagattcatgacctggctctgtgttccagctcaggctttctctctcatatcacctcttgcctctctgttgcccccatattttcccctctggttggttggtgctcctttggaac

SEQ ID NO: 8230 - DNA, 987 bp, Homo sapiens
cttaggctcgaggaaaatctctgtggatggaacaatattcctgctttcacagagtgtacagaccttgataggagccagtgtttctctggtaatcccaatgaaaaaggatgacagtgacacaaattgggaccttcatgagaactggacatttggtctccttgaatgtgctcctttgtgcagaaaaaaccgagattgtgtcacagcactccagcctggacaacagagtaagactccatctcaaaaaacaaactataaactaatttcctcccaaagttagttcagcctacacccaggagtgaacaaggacagcttggaagttagagtaaagatggagttggttaggtcagatctctttcactgcctcagttacattttgcaatggtggtttgctctcatgagctaggccaaggctagacttcaccagatgctgcatccgtgttcaacactttgccctccctaatctttgtttcaaagagtgctccctcagttaatcacatgcttctaaatccttgtcttaggttctgcttctagggaacctgacccttacgtatgtacatatgcatgaacatgcatacatacatgtacatatgtatgtacttacaatgactttttaattttcagctggaagtgatgtttattggatcagtagtgatgcaggggatggcagagggagaaaaactatgatgcagggaccatggcagcctcaacaggcccctaaagctgctctggagctaagaaggccgggcctttatgttcttacattgatcagtcattaggtacaggcctcctgggaaggggcatgaccttgggtgaggctgcttttggatgtggaggtgacccctgaagagactgacagccagatgccttctgctgactgtactaccagtaactgagctaacaagcccttcatggaaaggtattttgggccacattttaccatacatctcagagagaacaggaaaggtggcatctctgccatgctacatc

SEQ ID NO: 8231 - DNA, 459 bp, Homo sapiens
aaatgggaacaataatactgcctatttcagtgggttgctgtggccatttaatatggtaataaacaagtgcccaatacgtgttagctattgtcgccatctgactgaggagttgactgtgatttgtcaaaaattgtgtctcaggctattaaaactagacagcactgttaactgtctaatggtgtgatatttccaaagagggctggatgagaaaagggttagtgttcttaaaggccacattaggtaagagacagatatgggaatgctgttattctcagcactcagggctatggatttatagtcttcaggaagaaaccacattaactaggttgtgcattgtcagcgaaagtactgataaagtactgaaagttgacaaggaggacagtatgaatttctcttaaaggctgatctacatgagaaaagtaaacacttgctgctgtagtgggtactcggtgaaaaaat

SEQ ID NO: 8232 - DNA, 531 bp, Homo sapiens
tctggaagccactggctgccccaaggcccccgataggttcccaaggcagctggccccctcagggctggtgtcacggagccgccgtccttccctgatccaggacttggcatctggccacacttttatgactcatctttacccatctgtggccacagactcaggagctggcttccccagagccaccagggaacacgagccccagcggtgcccagagcgcataatatgtactcactcgatcccactttacaaggagcagagcacttcaactttagcaaggccgggacccaccccaggcctttgggcagcgctcccctgggtctgggctgtggcagcatcacactgctcatgacaacagcattctgccctctctcaaccagcgattcctgggctccctctgctccaccaaatgactccccagtcacccctcaggagctgctggcactgtcaggtctgtcttctgttccatgctcttctgtcaataaactccccgcatggagacctctgtgccacaggatgtggcaggtttatgac

SEQ ID NO: 8233 - DNA, 317 bp, Homo sapiens
agcttcggtgtggcttttctgcggccagcttctttgaggcctttttctttcatggatggtagagagcagtctacagcctgagacccatcacaaggttccttgtgagacacctgggggactccaaacagccggaatccatctgcccactggtccggagacagggatcctccgcctccttccagggttgatggctcaggaggccttctctgcaggggaccaggacacaggaaagccaggaagagatgagctgggaagggagctgttgggggccattctggttttaaaaataaagcaggactttcgttgcttgttataaa

SEQ ID NO: 8234 - DNA, 321 bp, Homo sapiens
actttatatatcctttgttgaaacttttgtgtagaatcctggaataaatcattagtcttatgcaaaactgtgtctacttcttaaaacttgaattgaggaaggaaatgctttgtaccaagatggcaaatattttattataagaacatttctgtttcttcctctcatactactatgttcattgtactgtatcttcctctgagagggtttaaactctttagagaactgccttaatttttgtatgtattggagcaacataatcagtgtttgcaatgttttgataaaagtaaattcttaataataaaattgttataatctcccata

SEQ ID NO: 8235 - DNA, 1333 bp, Homo sapiens
gaaactgactgacgttaagtccttagtaaatatttgctattactttagtcccagctttattgttcattagctgttggggcatggggatgaacctctctgagccctatttccctcatctataaaatgaacatactagctgggcatggtggctcgcgcctgtaattccagcactttgggaatgtgaggcaggaagatcccttaagcccaggagttcgaggctgcagtgagctatgattgtgccagtgcactccagcctggatgacaaagtgagagctgtctctaaaataaataaagtaaataaatgaataaaataaaatgaaccaatgaatttccaccccctggaaatataataagcttcaaatgagataaaatatgaagagtttagtgtggcgcctggttgtcaatggatgctcgacaaatgttaatttctcctccttttcttactgccttccttcctgctttcctccttttttctaataggatggaaagcacctctgatagctcattgaattcatctctcctccagtttgcttgtttcatggaagatttaaagttgttttctgtgacgtcactggcatgaggctgtgaaacctaccagtgagataagttaagcttcctaagggttacctctgtcatctgcatgatgcagaaagactgtgagcctgggatgtgtgtagtgatgacaggcaaagagagttttaaaagttgtcttaatttttacaggcttctggaggatctgttgctgattgcactggtgagttttgggttttttttccatctccccattcctgactgtctcccctatggttcacccaatgtctatgagttattttagcttccagtaatatttccatttcagtcaaaacaacaatgaaataagcctggcaaagaaaaatctatatgatagctggttttacaaaggaaggcataattacaaaatactatagttgcttttggtttctgtggggtcaacaacacctaaccaagagttttatcaataaaaacaacctttgaaaaaatgagtgattattgattatgactataaagtatagatcttttgaagtatctgcattcattcagcctccagatggatgagtttttacttgtctgtaatccatccatccatcctttcattcattttatttattcgatgaatatttttaagtgctttgtgccaggtactgtgacacgttcaggggatgaaatggcaaaaaaagaactgtatttgtcctcatagggtgtacggtctacctagtgtacacatcacatgcttgtcatcatttaaacacactccaagactcatcaaatgtcctgaaatgcatcagaaaaagaa

SEQ ID NO: 8236 - DNA, 774 bp, Homo sapiens
gaatttcacattagcagagtcagaatataaaaatgtaactttacctctctatacatgatcataacttcactctctagccattgtttttcactaaaggcagtgaagagtctttggggatgagggttctggccccgtcactgatgctttcattggccatgaaggctttgctggttgttggtgccatccatttctctgtgttcccttttctctttatgttagtcccactgggccccctccgttctgactgtgagagttctccaggcttgcaggcttgtgctcagctgtttcagtgcctctctggagcatgcaccttgggaagtgctatgtgggtctcagaccaccctcctggtgcaggggcctgcttagggctgagcctctttaggaggactgcactctgggaagaaccaatgatgtgtctgggatttctgttagctagatctctcataaattccaagtcttagtttgggatggaaagaggtagaggatctggacttttcagagacttagtagcatctttaaaagaaaaatacttagttcttccagtggaaagctgtgggttccaagagatatctgctgtgcatttatgggcctattttagagcagaataccaaaatattcaccataattttaaaaataaatattaaataattaaaaaattggtacagcctgccaggagctcagtgtgcaatggtgacatccagcctgtgaggccacctggtgcggcttgggaacccgcagaagcctgcactgaagcccagcaaacccctcatccta

SEQ ID NO: 8237 - DNA, 420 bp, Homo sapiens
gaatgctatttgtccattgttattctggaactgaaaccccaaattatagtcacactatactatgacttgtagtcccatttcataggttgcatgatgaactaatggaaaggctggaaaacatcatggagaaagtcagcaacacagccatgtcttggatgctgggtgtgtactatgtgtatcatagcaacaagcaaaagggcagagatgacacttttaaggtttgtcacccaaaaggttttaaagagcaactcacaacggaattgaagtgaactacaaggtgtttgaagtcaactgcctttggcaattagttttaattacatattgtttcccctttttgctaacattattcctgggtctttttaatctatgggatggggggtttctggggatagccagcctttgactttatcttctcttatt

SEQ ID NO: 8238 - DNA, 355 bp, Homo sapiens
tttctaagtagccagggtatccagatggcgtcatggcttccaacccaccctgctttccttttctttttctaattaattattaatagaatcaagaaaggacaatacaatcaatgaaaaaggataggcccttcccttttccaaagccagtttgggagccatgacagagcagcttggccatggcctccctagcgcaggggatcatctgacgagaggagagagccggccagtgagtcactgtcaacaatgataaatcagaggccggctgcaatggctcacgcctgccatcccagcacttttgagaggatcacctgaccccaggagttggagaccagcctgggcagcatggcaaaacccc

SEQ ID NO: 8239 - DNA, 353 bp, Homo sapiens
tgagatataggaaaaacccaagtgtctgtgttcccccactctcacacccatgtaacataacacttctcacaccagatgtggggggatttctcctcataccccaagtgagtctccagcagataccagctgggtgtcctacaatgtaactcagtcctgacactctatctggagacagtgtcagatcccacaagttaaggttcagtcccacaagaccgccccactgcagatgccaatcccaagttccaggctgtgacctgtactggacaaattctgtttttctacatgaccctccgtggatttgattactttcctggagtggctcacagaactcaggggaacacgttacttttatt

SEQ ID NO: 8240 - DNA, 660 bp, Homo sapiens
  misc_feature (369)..(369): n is a, c, g, or t
ttcttttccagtttcctccatgcatctgtggacaccaaggcagctctgcctctgagtattggcggaccatcggccatgtcacgtggggagcagctgagcctcacgtctttcatgatttagcagcctagcctgggttcatcacatgttggctcaacttggttgcaagagagaatggaagcaacgccccttgaggcctaaattcaagctgacacaactcacttctactccagtctatttcaaaagcaactcgagaagccagctcagattcaaggggtggagaaatagaccccacttttttaatgggaggaacttgcaacgttacattagaaaatgggcatgggattcaggggagggatgggagaatccatnggcctttttccacaatttataatatacacctcgtaccttatgtaacttgtctaacttaattctcacaatagcactgaaggttaaggcaaaattcctattttacaggtgaagaaactgagaaccagacatgttagtctggattaggcaggacagatggtgagtgatgaatccaacactgggacttgggtgtgtctgactccaaagcctgtgctcagtaccacgacggagctctgcctccctacataatgctgcagtgaagggtggtggtattactaagtattatacggctca

SEQ ID NO: 8241 - DNA, 373 bp, Homo sapiens
tttacaacctttgcatgtgcttcaagtttttcatgtttaagatacaaatataacctcaagcaatttgttttcatcttgtagtcataaaacatgtgcaggacacagaaatcctttagctcttaaaggacacactattaaacataacttatttatctgaatatcaactatgtttacatgttgataaagagtatagttctgaaccaaataattaaattgtgccattcatatcacttagctgattcttattttaaataattcaagttatattcatatctaccttgtagattataagagctacattatatatttctaagcaattttaaattaattttgcaaagtagttttcagtataggtcatatacatttagtgtcc

SEQ ID NO: 8242 - DNA, 415 bp, Homo sapiens
tttattcagaatggggactatgttgctcatgttctctaaagacaattttgactattaagttgatgtatgacaaatttgtttttaaaataattctgcaacttaatgtgatttatatagattgacttgaaagatgtaggatttcattctttcattaatttgttcatgcacgtaactaatatttaatgaacatgtatcgcggcctagggatttttttttccatctcctgggatatagtggtaaaccagacaagcaaaaaccatgccctcttggagcctatgttgttgtgattcttttccttttgtctcattagcagtttgtgtattgaacttgctgcagagctggggaggctgtgcaggcattactgactccagcattgcttctttgctagggactatgttgtttgcagcctgatccg

SEQ ID NO: 8243 - DNA, 445 bp, Homo sapiens
gagcaccctgcaacctgtttttagaaagaggaggctgcaggcgggcgcggtggctcacattttttctcattataaagcatatatactcaatatatataatttaatacattctgagtctttccatgttaaaattcatctgcaacaccattttaagtgctgaatattatactgtaaggacgtaccataataataagcagcacttttattatgtgccacacgttttatctcactcaattctcacagcaaccccatgaggtaggcattattatcaccttcattttgcctcagaaaaactgagggctacagtgattaagcaacttgtccaaggggttatgcagtcattgctagaactggaattcaaatacacgtaacgaaggctctttcgattgacctattccctattgttagacattcaggctgttgccatattttttgctagctctta

SEQ ID NO: 8244 - DNA, 425 bp, Homo sapiens
aagtaagccctgatgactctcactggcctcctgctgcacctgtccttatatttgacctgttaggttggttactttaaaaagccagttacggggaggctcatttaaaaagacataacacctgtgaaagattattttaacgtggaatatatgactggacaattatttgccaatctgatgaagtagggccacaggttttgttttcattattctgtatctactgatcagcatatccacttgcttgcacaggctacacctataatgtccacaacttccagttgcctcttatgtaacaatagaacaagaacataaagatacagaggaaagctgagagcaattctaaatgtctatggttttttctttatctcttgttgttatacatccatatctgattcaacaataaaacatgtaacattgcttatccagta

SEQ ID NO: 8245 - DNA, 756 bp, Homo sapiens
cttaaagttgaaaggtaacgggattggctgccaactccagcttcagagggggaacgtgggccagtagaaggcagggaaggtgtaggggagccggtgcgttcatccaccttttgccaaggttgaggtttccaagtgcagacggcttctctccttgggctgagcggtgcgcaccgtccgtctccgcggactggagtctgccctgatgccccactggccagtcggcgctgactgttgcatggagcccccgagggtgctccacagcgcggccttacacccagggggcgacccctggcccctgagccgcgatccatgtagcactcctccccgcccctccaccccagccaccgcctctgttcacaccgcacccctgccgggcggccggcccctactcccgcggctctgaccgccgttctgtaaataactggtgtgcacctgcgtactaatctcacgactgttaacttccaactttgacgaggccatgcgagcgacacgcgcgactggggaaggtgcaatactgtcctgggcatatgcactttggtttatcagggatattttattagtgttttgtatgtatttaatgacgtattctataggttccattgtctttgcttttctggttttttttatgagacgttagcgtgtgccaaagtgactgtgaaaatgacctttcattcttactaatgatggaaagacctcctgtcatgcatcccacaaataaactcaataaaagttccatgaaactgggaaaatgggttt

SEQ ID NO: 8246 - DNA, 343 bp, Homo sapiens
aggtcttactatgtttcccaggctgggctcacactcctggactcaagcaatcctcccaccccatcctctcaaagtgctgggattataggcgtgagccaacacacccagcttgtatttgttgttgtctgtacaaatcttctactcatttttaagttggattgtttgttgctatgttgttgagttttatagttttgttttttttttttgacggagtttcgctcttgttgcccaggctggagtgcaatggcgtgatctcagctcaccacaatctccgcctcacaggttcaagtgattctcctgcctcagcctcccaagtagctgggattacaggcatgcgccaacc

SEQ ID NO: 8247 - DNA, 3454 bp, Homo sapiens
cgcagtcttctcccatcaggatcaaagctaactgaaggagtatccagttgctggtttctaacagctgaaggcaatgaatggctacttcaaggacagatagcagctggagatatagagaacatttccagtcaaccaacaatttcactacaaattcctgatgattgcttatcacttgaagccattgtatctgtcagtgtgtttctttattactgtagtgcagacagcagtgcttgtatgatgaaggcaattttgttcagtcagcctttacaaataacggatacacagcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaataaagctatgctccttacttacttcttttattataaacaaattcctttgctttggctgatactagctgagtcattgatcatcattggtaccatgatattgtaatctatgctgctatttggcacaagactgaagttcacactacagtagagaatactataagataatttgcaataaatactgataataataataccagatattttaactaactttttctacctttattaatagcaatcagcacacttgaatgtgtaaatttcacagtaactttaggcagaacttaagctccaggccacatttgtataagaacaccaagtattcaaggcataaagtctgttgtaagccaaaaaaaagtcttttcatcactgtagaagcttaaggagtacatcagtggtaaatacgatctttattctcttctgtggttttctcagttgagatatttttaaaagagagttttgatctatttttattataaattatttgttatttaacataccattatgaatgccttaaaactttgtacagataaagttggacatagaatctctaaggactgactcctttaactgtttttgagtgactacattaccagataatgaatgagtccccagaaatattatgactttcaaggaaaaagggactttaggacacattacttagtgtctgtgataaataatttattgtgacagctaaatctgatggttacatatcttgttttggaaatgtacatttcacttgtaagcattaaatgcagatttgttgagtttaggttttgaggttttttttcgttcccatattcagaatttaaattatgatcatttattgtgatgtttttaaaaatcacttttaagccttaaaagtgaaattttcagtgtgaggtgctttcatgctattaatagatacagtatatcctaatatattagtcttcaaaatattaaggccgaaacagtgatttaatgatactattttttaatttttgttgttttttatccctaaaaaaagatattggaaaggttttttttctattgtcataatttataactacttaaaagcctaatcttgttttccttaagacctattcaacatgtttgtgatttaatcagcttacaagggtttaaaaacatcaggtgaaccatgtttatttattcagtaaatatttatagacaatatggcataatatgcttcccttccctgtaaaaacagtgctaaatttgaagtgtaatcttttttaaacatcattgtctatttttaattttgtttgaaatgtagtattagtttgttttattcataaggttagctgaatctctgaagtaaggatgtataaatcatgacattgatttaattagtcatctactgaagctacttttaaagagaaatatagatataaaattaaaaggaatcctgtttaaaattatatgtaattacctcataaaccttttctctccacaagcaatcaaaaaaatgaaatgttctgtaataaaagggtgtataacatactctcttttatgagaataggccttagttattttattttatttttgagacgtagtctggctctgtagcccaggctgggagggcagtggcgcgatcttggctcactgcaacctctacctcctgggttcaagagattttcctgcctcagcctcccaagtagctgggattacaggcgtacaccaccatgcccagctaatttttttgtgtttttagtagagacagggtttcaccatgtcagtcaggctggtcccaaactcctggcctcaggtgatccgcctgcctctgtctcccaaagtgctgggattacaggtgtgagccaccttgccctactggccttagttaatttttaatctcatttgacttattatgtttctcatttctagatggacaggatgagaatattttggcccaatcattttctgtttaaggacttaaacaatttcacactctaaatgaagtatatacaattttaatttactaatttagaaatatctgagtttatttttcaatataatatacaaacacagtgtttgttatacatgttcatgtacagtgaaaatgcaaaggcattttttagactctattccccttcatttgtctagacagttttaggttagccttagcttatacttttcttgactttcaaaatacagttttattgaacattcttattcttacccactgccagtctgcattgttttttacattaaaagtattatttatagtagactaatatgattttgaataaaatcacacttaagcaatatagataggttcctagaatttatgacgaggataaacctctcacataagaggaagcactagaaagtttatttttaaaacttgttgatccatattctataaggactaatgcatattttttatcttttgcttttcttgttggataaattattatgtccagtgatagtttaaaaagaacaagattttagtgtaagtcacctcacttgaaatgccagtaatgtggtattacacacattttatataatacctggaatctttgccctaaattattctgctggtttgtcgctatttttttcctctcctctttattatttcacaaatggtagaatttcttgatatgattcttgtaaagagtttagcttatcttgaacattctgtcttaagcaaatatttaacaagagaaaactttgtagtttaatcacccataagtgtaactttagcaaaattcaatgactatgaaaaataatttttttcttaactgttctaataatatttagttataatattatcaaaccttcagaaagttataaatcctaacagccagaaaaaaaaatttactatgtgtatatttatataggtgtgtgtatacacaaagattaagaattattcatgaatcttttatggccaatatacttttgagcttgtataactgagataagttactctttgcttgtttttctgtagttggaaaatttaggaagttattaaaaatacatatctctataatgt

SEQ ID NO: 8248 - DNA, 2162 bp, Homo sapiens
cgcagtcttctcccatcaggatcaaagctaactgaaggagtatccagttgctggtttctaacagctgaaggcaatgaatggctacttcaaggacagatagcagctggagatatagagaacatttccagtcaaccaacaatttcactacaaattcctgatgattgcttatcacttgaagccattgtatctgtcagtgtgtttctttattactgtagtgcagacagcagtgcttgtatgatgaaggcaattttgttcagtcagcctttacaaataacggatacacagcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaataaagctatgctccttacttacttcttttattataaacaaattcctttgctttggctgatactagctgagtcattgatcatcattggtaccatgatattgtaatctatgctgctatttggcacaagactgaagttcacactacagtagagaatactataagataatttgcaataaatactgataataataataccagatattttaactaactttttctacctttattaatagcaatcagcacacttgaatgtgtaaatttcacagtaactttaggcagaacttaagctccaggccacatttgtataagaacaccaagtattcaaggcataaagtctgttgtaagccaaaaaaaagtcttttcatcactgtagaagcttaaggagtacatcagtggtaaatacgatctttattctcttctgtggttttctcagttgagatatttttaaaagagagttttgatctatttttattataaattatttgttatttaacataccattatgaatgccttaaaactttgtacagataaagttggacatagaatctctaaggactgactcctttaactgtttttgagtgactacattaccagataatgaatgagtccccagaaatattatgactttcaaggaaaaagggactttaggacacattacttagtgtctgtgataaataatttattgtgacagctaaatctgatggttacatatcttgttttggaaatgtacatttcacttgtaagcattaaatgcagatttgttgagtttaggttttgaggttttttttcgttcccatattcagaatttaaattatgatcatttattgtgatgtttttaaaaatcacttttaagccttaaaagtgaaattttcagtgtgaggtgctttcatgctattaatagatacagtatatcctaatatattagtcttcaaaatattaaggccgaaacagtgatttaatgatactattttttaatttttgttgttttttatccctaaaaaaagatattggaaaggttttttttctattgtcataatttataactacttaaaagcctaatcttgttttccttaagacctattcaacatgtttgtgatttaatcagcttacaagggtttaaaaacatcaggtgaaccatgtttatttattcagtaaatatttatagacaatatggcataatatgcttcccttccctgtaaaaacagtgctaaatttgaagtgtaatcttttttaaacatcattgtctatttttaattttgtttgaaatgtagtattagtttgttttattcataaggttagctgaatctctgaagtaaggatgtataaatcatgacattgatttaattagtcatctactgaagctacttttaaagagaaatatagatataaaattaaaaggaatcctgtttaaaattatatgtaattacctcataaaccttttctctccacaagcaatcaaaaaaatgaaatgttctgtaataaaagggtgtataacatactctcttttatgagaataggccttagttattttattttatttttgagacgtagtctgaggcaggagaatggcgtgaacccgggaggcggagcttgcagtgagtcgagatggcgccactgcactccagcctgggcgacagagcgagactctgtctcaaaataaaataaaataaaataaaaaataaaacaaataaagac

SEQ ID NO: 8249 - DNA, 797 bp, Homo sapiens
cgagaaggggaagaattttatttatctgccactaatccccatgtgtctcatacccaaatctaggattttcctcttcccacctggagtatccggcgtgcatggtttatccacaattaaagcagactgcaggctgctcccctcaccagaaagccgctcccttaagcagccatagattacatgccctggctctgcctgccagagaaagccggtggatttgattttgttagcaagagctgactgagaccctagcagctgcattctactttacatattaaagagtggaaatacaaataggacagtccttttgccactgcaagagcagggggggttaggtgggtagaaaggcaggattttacttgtggaaatcagtgcctgccttccatccacaaaaaccagatgtcaatatggaggaggcacatgtcagcggcgcctgggaagcctgagttccagctttccctccccacaaccctgctctgtaactgtgggcagagcatgtctgctccaagagcctcagtttacacccctgaaaaatggagttaatgccttacagggattttatgagccacagtaagagattatgtgtgaaagaaaaataaaaagcattttgctattattcttagggtatctggccacatttccattatctctgactaaggtaccaaccaccgatttctgagttcagtaggagacagtgagacagaggccaaggaaccccaaccctgggcctaaaagtggtccagtcagtgtttgcaaactggcggacactcactagtgggtcatgcaattgattccatgga

SEQ ID NO: 8250 - DNA, 417 bp, Homo sapiens
gtgaaatattagttggaggatgaagcagatagtgaggaaagttgagccaataatgacgtgaagtccgtggaagcctgtggctacaaaaaatgttgagccgtagatgccgtcggaaatggtgaagggagcctcagtttacacccctgaaaaatggagttaatgccttacagggattttatgagccacagtaagagattatgtgtgaaagaaaaataaaaagcattttgctattattcttagggtatctggccacatttccattatctctgactaaggtaccaaccaccgatttctgagttcagtaggagacagtgagacagaggccaaggaaccccaaccctgggcctaaaagtggtccagtcagtgtttgcaaactggcggacactcactagtgggtcatgcaattgattccatgga

SEQ ID NO: 8251 - DNA, 1757 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8252 - DNA, 840 bp, Homo sapiens
  misc_feature (806)..(806): n is a, c, g, or t
tatgcaggctggtactggtctggggtgtagggatctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctctccgaanagaggctccccccggagccactccaaagccgcca

SEQ ID NO: 8253 - DNA, 474 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctctatcaggactgagccaggagccccactagcctgtgcccgggcatggcctggcagctctccagcagggccctcttggagcagagtgccccgtggcaggagcgcagcaccatgtccctgccccccgggctcctggggaacagctggggcgaa

SEQ ID NO: 8254 - DNA, 295 bp, Homo sapiens
  misc_feature (35)..(35): n is a, c, g, or t
tggaacgagggcagctggggcgaaggaagcaccgngcctgggtcttgctggagtcgcagaccctgttgtgggccgctcgagctggtgggcagcctcttggagcagagtgccccgtggcaggagcgcagcaccatgtccctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8255 - DNA, 1838 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaaaacagaacacacaacaaacacacaacaaaaacaaaaaaaaagagggcgcggcaaaaaaacccagggcgcccaaataaacca

SEQ ID NO: 8256 - DNA, 1952 bp, Homo sapiens
tatgcaggctggtactggtctggggtgtagggatctcgccggacggctcccagggagagcagacgcgccagacgcgccaccctcggggcgccgacggtcacggttcccgggccggtgctgttcccgcccccagctgccttctggcccagcctccactttcagcagacccagcactcagaggcttcctggggcagctgcagcccctccacagtggcccaggtgccccctatcccagcggaggcccgctatggcctctgacccccaaagcctcagccttggacaggtggctcatggagctccaggcacagagaaggccctggaggacgcagctggggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8257 - DNA, 1615 bp, Homo sapiens
gaggacatcctggagccggatgccgcggaaccagacgtgcagcgtggcaggagcttccacttctacgatgccatggatgggcagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctgacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8258 - DNA, 1652 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8259 - DNA, 1560 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgtcctgccctgtcttggcaggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8260 - DNA, 926 bp, Homo sapiens
aggctgtactggtcggagttgttagatccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8261 - DNA, 1253 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgccagtccagatgagcatgttagcctagaaagacgcactactgcacaggaaaatcattctgcacgtaccagacataaaatgctgcaagcttttgtactaatggcgagagtgtaagaaaatgggctctacttcagtgatcctgtggctggac

SEQ ID NO: 8262 - DNA, 877 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (843)..(843): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctctccgaanagaggctccccccggagccactccaaagccgcca

SEQ ID NO: 8263 - DNA, 959 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (798)..(798): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggaccagctggccctgcgagccttggagggaggcgctggagcagggccagagccttgggccggtggaagcccctggacggtccagcaggtgctgtcctggagtgccctggtgttgtctccggaatgctggtgccggaactcgctatccctgttgtctacctgctgggggcactgaccatgctgagtgaaacacnagcacaagctgctggcggaggcgctggagtcgcagaccctgttggggccgctcgagctggtgggcagcctcttggagcccagtagccatgtggccagtctaccatggggcccaggagttggggaaacacaataaaggtggcatacgaaggaaaaaaaaaaa

SEQ ID NO: 8264 - DNA, 579 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgaatgtggccagtctaccatggggcccaggagttggggaaacacaataaaggtggcatacgaaggaaa

SEQ ID NO: 8265 - DNA, 477 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccaggtgcctgatgtggtgctgaggcaggagaatgccgtgaacccgggaggcagaacttgcagtgagcagagatcgtgccactgcactccggcctgggggacaaagcgagactccgtctca

SEQ ID NO: 8266 - DNA, 996 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggtgggcccgaagagggcagggcagggcagggccccacccaccccaagcaaccctgcttttatttatttatttatttaaattattttttgaggtgaggttttgctatctcggccagggtggtcttgaactcctggcctcaagcagtcctcctgcctcggcctcccaaagtgctgggattacaggggtgagccactgtgccaggtcccagccttgctcttgggaaggtcacaaccttggggcatcaggaaagtcccagaggcaaaagagcgctgtggccggaaccagcttgcaggaaggaagctgcaggggtcatctggggcctccgctgccaggactggatcctaaggaccggactgagccccaggctgctgtgaggacaaggggtggtgtgaacacgggggcccaggtgagggggccgcacctcgagtctggacttggagtcc

SEQ ID NO: 8267 - DNA, 699 bp, Homo sapiens
gcccctcggagcagctcccagccctgcgcttggctgcggagcgaagtcacctggcggcgggctgccccggcacccggcccgcacccgcaccccacggcccggtgccagggcccagcccgaggcccatctccatgcctcagggtgagggccagggccatctgagccagaagaagacggtcaccatcccctcaggcagcaccctcgcattccgggtggcccagctggttattgactctgacttgggtgagctggagttgggggtgtctcgggcccaggccctggcagagaaacagggaggcctggggagagctacccgccagcttgggctgccgtgggcccctggctgaacaacgtcctgtgtctggcaggtggctgaggtcctgtgctctggtgtgtgggtgattgggcagggcctgagctggacaggggagctcctagtaggggaggggaggggatgctgggatctaggtgacatgcctgtccctgtctgctcccgtctggctgccagacgtccttctcttcccggataagaagcagaggaccttccagccacccgcgacaggccacaagcgttccacgagcgaaggcgcctggccacagctgccctctggcctctccatgatgaggtgcctccacaacttcctgacaggtcagtgccctcctgaccgccccggggacctttggtgggctctcctgccc

SEQ ID NO: 8268 - DNA, 2093 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaaaagaaaaaaaaaaaaaaaaacagaaagaaaaaacaagaaaggggggagggcactgccaaggagataatactcccccggagggggggccacgagagtgttgacgtgcaccccggctcttgggtgtgtggacacggggggccccaaatagagggggaggcgccctagttaatgaaaccgcagaggccaaggggccgccgtggttctaggacacagctgctgtaccaggggggagacaacgcgggcaccatcgggggagcaccctggtgcggaaggaaccagcgctaatgactacgggcgcgggggagccctacagtgcgcgcacacagaaacgccacg

SEQ ID NO: 8269 - DNA, 2022 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttgggtgagctggagttgggggtgtctcgggcccaggccctggcagagaaacagggaggcctggggagagctacccgccagcttgggctgccgtgggcccctggctgaacaacgtcctgtgtctggcaggtggctgaggtcctgtgctctggtgtgtgggtgattgggcagggcctgagctggacaggggagctcctagtaggggaggggaggggatgctgggatctaggtgacatgcctgtccctgtctgctcccgtctggctgccagacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8270 - DNA, 1608 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8271 - DNA, 2103 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttgggtgagctggagttgggggtgtctcgggcccaggccctggcagagaaacagggaggcctggggagagctacccgccagcttgggctgccgtgggcccctggctgaacaacgtcctgtgtctggcaggtggctgaggtcctgtgctctggtgtgtgggtgattgggcagggcctgagctggacaggggagctcctagtaggggaggggaggggatgctgggatctaggtgacatgcctgtccctgtctgctcccgtctggctgccagacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaaaacagaacacacaacaaacacacaacaaaaacaaaaaaaaagagggcgcggcaaaaaaacccagggcgcccaaataaacca

SEQ ID NO: 8272 - DNA, 1460 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (1299)..(1299): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcgctggagcagggccagagccttgggccggtggaagcccctggacggtccagcaggtgctgtcctggagtgccctggtgttgtctccggaatgctggtgccggaactcgctatccctgttgtctacctgctgggggcactgaccatgctgagtgaaacacnagcacaagctgctggcggaggcgctggagtcgcagaccctgttggggccgctcgagctggtgggcagcctcttggagcccagtagccatgtggccagtctaccatggggcccaggagttggggaaacacaataaaggtggcatacgaaggaaaaaaaaaaa

SEQ ID NO: 8273 - DNA, 568 bp, Homo sapiens
gcggccgctgggggcaggtggcgggtgggagggagggaggtgggctttcccggtgggcgttcagaaacccccttttacctgactctctcccagtgctgagtgaaacgcagcacaagctgctggcggaggcgctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaa

SEQ ID NO: 8274 - DNA, 709 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (9)..(9): n is a, c, g, or t
ggnangngncctgggcgggccctgcgtcaggttgcagtttcacttttagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagagagtgtttgcccaccagctgctagccctaggaaggccaggagcccagtagccatgtggccagtctaccatggggcccaggagttggggaaacacaataaaggtggcatacgaaggaaa

SEQ ID NO: 8275 - DNA, 465 bp, Homo sapiens
gtctgcctgtcctgaccgaggctttccagggccctgtaagcacctgggcagtgccagcccttctgtccctacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggagggaggcggagcgggggagggtgcccggggcacacaaggcctgcccagccagccagactcacctgcccttcccgtgcccacagctggagcagggccagagccttgggccggtggagcccctggacggtccagcaggtgctgtcctggagtgcctggtgttgtcctccggaatgctggtgccggaactcgctatccctgttgtctacctgctgggggcactgacca

SEQ ID NO: 8276 - DNA, 1873 bp, Homo sapiens
  misc_feature (1)..(2): n is a, c, g, or t
nnagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctc

SEQ ID NO: 8277 - DNA, 2288 bp, Homo sapiens
  misc_feature (1)..(2): n is a, c, g, or t
nnagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcttacaaatgccaaaattcattcagctttgatgataaacactgaggcccaatggcctttatcatctagggagtatgaagaatgagcaagaggctaactcagcgtgagttaccctgggaaaggaaagaagaaatggttcatataggacacacatagataccttcaagggtgtttgtagagttgtttcttaagtagttggtttccttcacagaaagttcttaaactcagaatatacccatccatgcaccccaccagcaatacaaagaccccaaacaaaaaattactatattcttaccctacgcatggcttcctcctcttcttgacgcttttcataatgtgcaaagtcatcaaagattgaggtggtatgcttgaaagtagcaattattttaagcacttgcttagctttttcaagggacg

SEQ ID NO: 8278 - DNA, 2404 bp, Homo sapiens
cctctgagcccagccctccctagcatcaccacttccatcccattcctcagccaagagccaggaatcctgattccagatcccacgcttccctgcctccctcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgt

SEQ ID NO: 8279 - DNA, 1744 bp, Homo sapiens
  misc_feature (1)..(2): n is a, c, g, or t
  misc_feature (1453)..(1453): n is a, c, g, or t
  misc_feature (1458)..(1458): n is a, c, g, or t
  misc_feature (1463)..(1463): n is a, c, g, or t
  misc_feature (1474)..(1480): n is a, c, g, or t
  misc_feature (1482)..(1483): n is a, c, g, or t
  misc_feature (1486)..(1486): n is a, c, g, or t
  misc_feature (1506)..(1506): n is a, c, g, or t
  misc_feature (1516)..(1516): n is a, c, g, or t
  misc_feature (1522)..(1523): n is a, c, g, or t
  misc_feature (1528)..(1528): n is a, c, g, or t
  misc_feature (1538)..(1538): n is a, c, g, or t
  misc_feature (1548)..(1548): n is a, c, g, or t
  misc_feature (1556)..(1556): n is a, c, g, or t
  misc_feature (1559)..(1559): n is a, c, g, or t
  misc_feature (1563)..(1564): n is a, c, g, or t
  misc_feature (1571)..(1573): n is a, c, g, or t
  misc_feature (1578)..(1579): n is a, c, g, or t
  misc_feature (1597)..(1597): n is a, c, g, or t
  misc_feature (1604)..(1604): n is a, c, g, or t
  misc_feature (1607)..(1608): n is a, c, g, or t
  misc_feature (1628)..(1630): n is a, c, g, or t
  misc_feature (1644)..(1644): n is a, c, g, or t
  misc_feature (1675)..(1676): n is a, c, g, or t
  misc_feature (1681)..(1681): n is a, c, g, or t
  misc_feature (1683)..(1683): n is a, c, g, or t
  misc_feature (1725)..(1725): n is a, c, g, or t
nnagcctcgggaggtggtggagtgacctggccccagtgctgcgtccttatcagccgagccggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagcaanccccncctanaaaaaaaaaannnnnnncnnaanccccaaatatggtataagancaaatatatnagttannaaaanaattgtaaanggcttattgnactcatanccncccnnaaacacnnnccccnnaattatgtaatccccccngaaaatnccnncaatataatgttaagtgggnnnaaaagcaagttacncctctgtaatacataagattttagttttgtnnggggnangggccaaccatatatggcacttatagggagaacaaaagagcncaaggcaaatgttttccat

SEQ ID NO: 8280 - DNA, 3504 bp, Homo sapiens
gggcaggtgttaagcgataaaggggggcagaacaagtcttttatccggccatttaattggtcaccttaagaaagaatcctatcttcccaccgcagctgagaagacacttctaagaggtacagctaaaaggtggaggactgatagacaacttagaggttggtttcgggaacgataaaacaagtaacgggctgcccggcctgcgccgcggagtcccgaggagcctgcgctgtgctcctctcgcggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgcctttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaatgaaaaaaaaaaaaaaaaaaaaaaaaaaagggggggcccttttttagggggagatcaccaatgggtgggggggaccctggtacactgtatcctgagaacgtgggaggggcgtacaaggggtctcatacggtgctcactacag

SEQ ID NO: 8281 - DNA, 3367 bp, Homo sapiens
gggcaggtgttaagcgataaaggggggcagaacaagtcttttatccggccatttaattggtcaccttaagaaagaatcctatcttcccaccgcagctgagaagacacttctaagaggtacagctaaaaggtggaggactgatagacaacttagaggttggtttcgggaacgataaaacaagtaacgggctgcccggcctgcgccgcggagtcccgaggagcctgcgctgtgctcctctcgcggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgcctttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaatgaaaaaaaaaaaaaaaaaaaaaaaaaaagggggggcccttttttagggggagatcaccaatgggtgggggggaccctggtacactgtatcctgagaacgtgggaggggcgtacaaggggtctcatacggtgctcactacag

SEQ ID NO: 8282 - DNA, 2620 bp, Homo sapiens
gggcaggtgttaagcgataaaggggggcagaacaagtcttttatccggccatttaattggtcaccttaagaaagaatcctatcttcccaccgcagctgagaagacacttctaagaggtacagctaaaaggtggaggactgatagacaacttagaggttggtttcgggaacgataaaacaagtaacgggctgcccggcctgcgccgcggagtcccgaggagcctgcgctgtgctcctctcgcggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggaagcgcggattctattactggaaactttgggactgaaaggccaaagcttctgggcccaccatcaacgcagctccgctttcatttctttcacatacaactttccacataagatttcatgcggaaaaaaaaaa

SEQ ID NO: 8283 - DNA, 2372 bp, Homo sapiens
gggcaggtgttaagcgataaaggggggcagaacaagtcttttatccggccatttaattggtcaccttaagaaagaatcctatcttcccaccgcagctgagaagacacttctaagaggtacagctaaaaggtggaggactgatagacaacttagaggttggtttcgggaacgataaaacaagtaacgggctgcccggcctgcgccgcggagtcccgaggagcctgcgctgtgctcctctcgcggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggtatgatggataggatggcttagcattttaactgctatttctgcatgacaccttgaaatattgaataagagggcttgtttaaatttagtgaaaataaataattgaagt

SEQ ID NO: 8284 - DNA, 541 bp, Homo sapiens
gacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggtgaatttcattttaagtttttctgctcatgactcttttctaatgagattaagttggctttccagatactttcttagcatcaaattaataatagtatttcattataataagctatcttaatgtgcatatacaaatgtacacccagtgttcatcttttttttccccttacacatcaatctataactcgatgtctttacttaaaatatatcatggtcatactaccgtaacgccttccttattctttgtaatggctacggagtattgcattttatagatatttacgttgtttctagttttctgccaagataaacagtgcttcaataatatatccttacataccatatttcatctgagtctgtcaattctaaaaaacacaattattttatatgac

SEQ ID NO: 8285 - DNA, 285 bp, Homo sapiens
aacagttccgtcgacctttttaaagaaacagataagtttccagaacaaagaatatttgaagattttattgtaaattcagaaaactttacagctactacgaggatgacctagcctgagtcccaactaacatcttcatttctttagtgaaaggagacagagagttagctgctttgaactctaggattgtgctcattttatctgtcttcattgatgaccttcatagtctgatatccatttccaaaggaagatgacttcaatctaagagcctcaaagaagacgtcgacg

SEQ ID NO: 8286 - DNA, 442 bp, Homo sapiens
agacagaatttcgctcttgttgctcaggctggagtgcaatgggtgatctcagctcactgcaacctccgcctcctgggttcaagagattctcctgcctcagactaaaaggaatctcttccaaattgagttcccaatttgaaacaagaacatgtagttatgttttactacattttaacttaaacatgaatataaaaatatgggaaaatgagcttcaaaatgaactttaaatgaaattatgaaatcaaagaccccagaaattaaaatgtgattcattttcccataaatttacattcttatatattctctattgaaagtcaaggtaaatgtaatttacgatttattcaaactgaaaaagttgctgggcatggcagctcacacctataatcccagtactcgagagctgaggtgggagaatcacttgagcccaggagtttgagaccag

SEQ ID NO: 8287 - DNA, 449 bp, Homo sapiens
ttcacactgggagccctaacacagagcctctgacctgcagctcatacccctgattattcaactgtgcccatggataggcatccctctgcccgctccggcccagccccttgtctcttcctgcatccatttctgactgagcccccctgactgatttgacactggctttgcccagatgcctgtggcaggatctctgtagttgggctggtgtcctagtccctggcctccctcaaccccactagccagccctgttgctgaagacttggcatgccttgtatccaaccccactccttaggaccccaagggaaatcacctccttttcccctcactgccccagaaaatggagaaggaagaagggggaacagaaaggaaggaggaaggcttgccgttttattcattcatctttattactttatttaatcaactcttcctaggggcttagggcagaaatt

SEQ ID NO: 8288 - DNA, 537 bp, Homo sapiens
agatgttccaggagtagaattcctgactgctgtgtgaaagtgaactgctactccatctctgaaacatatctgagaaacggggcagaaaaccagtgtaaactgctcgtggtgaaattattgaacattgaagtgtgaggcttgtcctaagagcacgtcacctcccttgacacagattctgcatgtccttccctctggtaggatcctccagttccgtttctcagcgaagtaaccagaggttccagtctgctcttgctttctgggaggaagacagagcacctagtaatagattcccagggtactgattggcaccacacatgactcagaggggacctaagccatcagcaggctgctctaaggacctacctcagggcactcagacagcctcaccaatcagaggctcaggagagggttttcctcactgccctccttgtgtgcactggtttcctgtttagagcagcatttagcagcaccacacacctcagatgtagaggatgaacctctcttatatgaaataaaatgatgtccagcaactactgt

SEQ ID NO: 8289 - DNA, 491 bp, Homo sapiens
agagttccaatctccagtacaagttttgttttccagtaaactgtttcattgtatttgatgcttcataaatgtatctaaatctagctcatcatgcactgctagctacacctaatcatacacacatgtctgaattactccactcctatttaaaggaaaagaacaaaaagtaagaatggcagatgtgttcataattaatatcctactgggttaatcagtagatcctcaggaatgctatgagggttttgatgtattcagaaaatcactgcctttatctatagacctctttaaagacaaacatacaacagttagtttttagaagatgtgatccttgcaaataagatagtaaataatattgtcacagacttgcctctttgaataacctaattccatgcttgattttatatgtttaagtgaggaatttatggttcatatttacagccagtgatatgtgcaaggattgctgtttactaacatcacactcaaaatttctt

SEQ ID NO: 8290 - DNA, 699 bp, Homo sapiens
ttgtagagatggggtttcactatgttgttcaggctggtctcgaactctgagctcaagtgatccgtccgtctcagcctcccaaagtactgggattacaggagtgagccgctgcacccaggctggactagttcaacacatgtggctagtgattaccatactaggacagcatgataacgaagcacaaatcagagggccagacactatgccaaaaagaggggaaagaggtgactgaacagaaggctggcagttcagggtgaggaaactgaggtttacaaagaaaacccaacaacaatgagctaaatagatgctgaggcttactatgggatggcagcatgagacaggaaagttagggaccactaattccacgcatgctgtgagagctgtgtgtgccggggacagaaagaagatgaaaaccaagctccagaagattgacagtacatatcgaattaatgtgcacacagataaccaaacgacctaggttggtccaagtgggcagagtaggttactcagggtgttcatcacacaagtgcaccggccaggagctgactggggctggatcctgacccaactccacctaacaagctgtgaggctgggcactgtggctcatgcctgtaatctccgcactttgggaggctgaggtggtggatcactttaggtcaggagttcaagaccagcctggctaacatggtgaaaccccg

SEQ ID NO: 8291 - DNA, 738 bp, Homo sapiens
ggattggggacccctgcactaaaaaactgttagaactaataagtaagttcagcaaagtggcagcataaaagatgcagaaattgattgttctgtatacaagtaatgaacaaagtagaattaagaaaacaatttaaaaaggccttaaagagaataaaatatctagaaataaattgataaaagaagtgcaagacatgtatcttgaatactagaaaacataattgaaagaaattgaagacaatgaaaaggcattccatgttcatcgattagaaaattcagtattattaagatggcagtacttctcaaagtgatctacatattcaacacaattcctatcaaatctcagctgacttcagaatctgacaagctgattctgagattcatatgcaaattcaaaggagctagaataaccaaaagaatcttagaagaacaaagttggaaccctcacaattttcaattttaaatcttcctacaggctgggcacgtttgctcatgcccataatcccaaccccttggaggccgaggcaggaggatcagttgagtccaggagcttgagaccatcctgggccacatagtgagaccctgtctctatttttataaatttacatacaatcaaaatcttcctacaaagctagagtgctcaagattgtgtggtactggcattatgataaacgtatagatcaataatagaattgagagtctagaaattaattccacacattttataagctcaactgattt

SEQ ID NO: 8292 - DNA, 98 bp, Homo sapiens
ctataatgccaacactttgggaggcctaggtgggcagattgcctgagctcaggagtttgagagcagcctgggtaacatggcaaaactccgtctctgca

SEQ ID NO: 8293 - DNA, 556 bp, Homo sapiens
tggcatctcatctaattgcccagggatgggactgcaagaacactcgaatgcacaaagcaaaagaaagtctcagcatggcaagaaatatcgacagatagaacgcttagcaggatcctggccgggagaccccatgggtgcagtctgcttgctgtaattgccggctggagtggaaaagaaaagactctgttttaaagctctcgaagcattcgtctctggttttagcagaacatataacatcttctgtaatttctatgtaaatacttgacagttgaaaagaattctttttttttcttcctatccagactataatttatggtggtttagtgggaaaaggggttaatttgatttaaaaactgaaaatgattctctatttggctttttaaaaagtatttatttaaaaaactctgcacagaacagacagaggggagacaaaggattctattgtatgactgacctaggcgtgccatgtctctttgctccctacacagacagaggcctggcctgaagcacgcaagattatgcacacatgggtccaatctttgtcacctgtcaccta

SEQ ID NO: 8294 - DNA, 284 bp, Homo sapiens
aaaagaaaatacaatttgacttatagataattaacttacagaacttagtagaactaataagtagtataggtagaatataacatgattataaagccataaatagttaataacacaaaattgagatatatctaacttttcaggtaactacaaggaagggtagtcctacctacccacatcttacctcttagggctattgaccacaaattactggctaggactatgactctgtgtggtattactgtgttcctgtcactggatattcaaagcaaagcttttattcaaaa

SEQ ID NO: 8295 - DNA, 657 bp, Homo sapiens
gggaagtataattatgcgtaggaagtgattgagaaccataatacaatctaccacaattctccaactagtaggtagtttgacttatatgaatagatagtggcttttatttgctctctatatgtagagaaataagtaaaacgtttttggtgtcaagttgaatggtggcatgtctattattacagtagtcttctctgtagttggtgataagggaaagggagtaatgccaattgaaaaacatgtagatatgtctgttggattttgattatttttgctagtggagaatagtatcacaaatattttgaaggtgctaataaccaaaacataattttcattgaacttgggacatattatttttcctttcctttcttggctttgtttctgaatttatctatctctttttagcctgctagacttcagataatagtaatttgctaacacttgagtgcttatgcttggtgtgccaaacattgttctaagcacttaatatgtgttaatacatttacttctcacaactcattgaagtaggtggaatgtaatattaatccattttacagatgaaattaagatagcatttaaataacttgtccaaaggcacacagttaataactggcatggaaacagatataaaagccagtgaattattcattttctgtagtt

SEQ ID NO: 8296 - DNA, 462 bp, Homo sapiens
gctgggacttcaggcgtgtgccaccatgcccagctaatgtttgtattttcagtagagacagggtttcaccatgttggccaggctggtctcaaactcctgacctcaggtgagccacctgccttggcctcccaaagtgctggcattacaggcatgagccactacacctggcctagagctgttttttaaagcacatgtgtgcatatatagaaatgtgttatataaacggtggtatttgagatattttcttttcttttcttttctttttgagacagagtctcactctgtcgcccaggctgtacctcatgatccacccgccttggcctcccagagtgctgggattacaggcatgagccaccatgcccagctggtctcgaacttctgccctcaggtgatccacctgcatcagcctcccaaagtgctgggattataggtgtgagctactgcatccagccctgagaaact

SEQ ID NO: 8297 - DNA, 157 bp, Homo sapiens
cctgggcgcctcccagggacttggtttgatttaaacaaaaataaaggtggcattgggtagcctgtgtgccaggagacggcttccctgcaaaagggacgccagcagtagccctgcgtccttccatatcacatccttccacgtgatagacacgtgtcaa

SEQ ID NO: 8298 - DNA, 427 bp, Homo sapiens
attgttattttctttttttttttttttttgagacagagtctcgcactgtcgcccaggctggagtgcagtggcacggtcttggctcactacaaccaccacctcccaggttcaagcgattctccttgcttcagcttcctgagtagctgggattataggcactcaccaccaagcccggctcattttttttggattttcagtagagacaggatttcactatgttggccaggctggtctcaaactcctgacctcatgatacacctgcctctgcctcccaaagtgctgggattacaggcatgagccactgcgcccagcctctctttattttctgttctcataatgcaagtaatcatgtgaaaattttgagattcattattttacagccaggtaattacactcaagttgattagtgattaggattgtcagggac

SEQ ID NO: 8299 - DNA, 452 bp, Homo sapiens
agcatgtaacccaggactgttctagcacggagtaagtgcccaatccatgttagcacttctgctatagccgccggcgggtctgccatgcttagtgtatactgggtgctcacttaatccttgcggaatgaatgtgggtggcaccttcccatgtaggtacttttctgcctgtgtggcatgcacgtttctgttggggacaccttgtgtagagatagatgtgtatcatacactcacacacgctctctcatctacaccaaagggagtgcacagggctgtcctcctggttgagggtccacgagcattttattgtgattaaatatttatccggggcttgtactatgaacattgcattttatggcagataaaatgatgtcatgtaaaaaaaggcttgaaaagctgtgtggccccattcacagaaaaggcagctgtcactagggaagcagagctgggagacg

SEQ ID NO: 8300 - DNA, 286 bp, Homo sapiens
aagagactagaggatgattgattagtagagcagccagaatatacataatatttaccaattaagtttgctgtcttacatgtgtgcacttcacggtaccccaaataattataacagtaacgtcagaggtcactgatcacagatgaccataccagatgttatagtaatgaaaagtttgaaataccacaagaattaccaaaatgttatatagagacacaaaggaaggagatgcttttggaaaaatggtgcccgtaaacttgctcaattcagggctgccacaaaccctcaa

SEQ ID NO: 8301 - DNA, 439 bp, Homo sapiens
agagtttgaaatctgtaagcaggccagtatgttgtaaagtacggaagaactggtttgccgtcttaaggcagaatttcttcttccccaaagaaatctccacttttgcttttaaggtcttctggctgattgatgaggcccacccacattattgggtggcctaatctccttaaactcaactgtgttaaccacattgacaaaataccttcacagtaacacctagattagtgtttgattgagtaactgtgtataatagcttagcaaatatgacacataaatgaatcttcaccattcaaaattatcagataaaaatctggaactatagccataggaggtaagtatgagttaatttgttttactagaattttgaatagcatatatactttccaaatcaccagtggggaaaaaatgaaagaaaccataaaataaataataaaataga

SEQ ID NO: 8302 - DNA, 774 bp, Homo sapiens
ggctgaaatgttgtgaaaatataggattggtctgtctcttccctgccacattccaagatttgaggcatgatatatatttcttagccctcaaggaatttagacttcttcagcttaggcccttgtcagcacatgaactgtcttaattcaaattggaagagaccatagtgggcatctgtttgtcctggctgctacagaactcctcaatttcttatccaacctctgcttataaatacttccaggccgggcgcagtggctcacacctgtaatcccaacacttcgggtggccaaggtgggtggatcacctgaggtcaggagttcaagaccagcctggccaacatcgtgaaaccccggttatactaaaaatacaaaaattagctgggtgtggtggtgtgcacctggcgcaagtcccagctacttgggagactgagacaggagaatcacttgaacctgggaggcagaggttgcagtgagccgagatcgtgccactgcactccagtctgggcaacaaagcaagactccgtctaaaaaaaaaaaaaaaaaacaacttccaatgatggggaactcattaacatttgttaaattttgtttgtttttcattataaaaatgatacatccttattatagaaactttggaagatgctaaaaataagacgtgaaaaaggaggggaggacccgtataccatctagaggctcctattaccttgttgtatttcttttttccccccgttcttgacgtgtattttttttcataactgcataaaatttcattgagtc

SEQ ID NO: 8303 - DNA, 591 bp, Homo sapiens
aaattgtttcctaagaaggttaatacattaccaaagtttcagaatgaggacatgttcatgtgaattttttaaggcaactccttttggcatctatgagagtagctgtgcttttattttacttagatttgtgggaaatatatgctaataatgttccagcctgaaaaaataacaggtatcaagatactcaagtccttaagctgaccttgttagaaatcctgggaaaggaaagctgactgttccaaagctgtcagtggggtgccagacattcactgtttgaacttaaaaacttggtgcatgttggctgggcacagtggctcacgcttgtaatcccagcactttgggaggccgaggcaggtggatcacaagttcagtggttctagaccagcctggccaacacagtgaaaccccgtctctactaaaaatacaaaaattagctgggtgtggtggcgggtgcctgtaaccccagctactcgggaggctgaggcaagagaatcgcttgaacccgggaggcagaggttgcagtgagccgagatcgtgcccctgcactccagcttgggcaacagagctagactccgtctcaaaaaaaaaaaa

SEQ ID NO: 8304 - DNA, 465 bp, Homo sapiens
gattggtcttgatagtcattgctataaagtcatggtatgaagggcatacaaggcagaaggagcagcataaggcaatttttttgtggtgtttctttgtttgtttttgagagctgttaagtaattccaggagagtaagagaatgaaggaagataaggttataaaatttggcaggaccaggcacagtggtggttcatgcctataatcccgaggccaaggcaggaggatcactggagcccaggagttcaagactagcctgggcaacatagacaaaaacaaaacaacaaaaatttttaaaaattttttaaattagctgggcattgtggtgtacacctgtactcccagctattgggaaggctgaggtgggaggatgcttgagcccaggaggtggaggctgcgagtgagcagtgatggcaccactgcactccagcctgggtgacacagtgagactttgtctcaaaaaaaaaa

SEQ ID NO: 8305 - DNA, 547 bp, Homo sapiens
aggagagggaaccgcgacagaaaaaacgcgatagaagaaagttcgaaacacagtgattctcaaacaggcaaaaattatataccccatgaagaaaggaaagagaacagagtacgagcataagccaaaaacagttgcttcacatcctacaacccagagggcactcctcaacaaaagtgatcaggctaaaatgtcaacagtgctccccaggttgagaaactgaattttaaactcaacctctagtttagatgaccactaggtctcaccgaatgaggagtttacagctcagaaacaaatctagaaaacttaacagccttggccaagcacaatggctcatgcctgtaatcccggcatgttgaactggatggtgaaaccccatctctaccaaaaaatacaaaaattaggtgggcatgctggtgtgtgcctgtagccccagctactcaggaggctgaggtgggggtgatcacctgagctccccaggtcgaggctgcagtgagttgtgatcgtgacactgcactcccgcctgggtgacagagccagaccctgtctc

SEQ ID NO: 8306 - DNA, 323 bp, Homo sapiens
tatttttcttcttctttaaaagagtacttgctgtgtaatccctaacagcttctttgagaactccaaccacctgtactccccacaggatgcagcttataaaggttcaccctctggctcccttgcttcatccaccgccttcatcctgaatcacttgccctgacccatttcccactcacacccatcttctgacattgtttgtttccaatttttcatttcccgtctgatcgttcccctcaggtctcagtactacttttgcagctacaaactttgcttctcttcttgactatgtttttgttttcctccagcatcactgcctccagcag

SEQ ID NO: 8307 - DNA, 454 bp, Homo sapiens
tatttgtcattctgtgcctggcttatttcatttaatatacagacctgcaatctcatccattttgtctgcagtggagaggagtttcttcctttttaggctgaataatacttcactgggtgtgtataccacagtttcttcattgaaacaaatttctgaagagcaaatattttaaagatgtcttggaatgtgaaacttcacggatactgtgcccattttattcttttctatttcccatcttatgtatatgcaagtgtataacaaagcagccatcaatgtgtgtataaatctgtaacttcaacaaatgtaaaatgtaaatgctaagtggtggctgggcgcggtcgctcatgcctgtaatcccagcactttgggaggcggaagcaggcggatcacctgaggtcaggagttcaagaccagcctgaacaaaatggagaaacactgtctctattaacaatac

SEQ ID NO: 8308 - DNA, 436 bp, Homo sapiens
aagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaat

SEQ ID NO: 8309 - DNA, 347 bp, Homo sapiens
gcagtgatccgagatcatgcgactgcactccagcctgggcaagagtgagactctatctcaatatttttttaaaaagaaaattttggaggagtgcacagatcatgtatcaagaccttatgggtggggcctttgtaaggactttggcttttattccgagaagctattgcacattggagagctttttcgtgggtttttgccagggtgtctttaccctttctggcttactatgacttgtaaacttctgtatgtgtctagtccatactgctttttgggctttctaagttttctatttaaagtattagcacaggatttccttcgacttgaaccacacaaagctcgcaggaaca

SEQ ID NO: 8310 - DNA, 359 bp, Homo sapiens
atgagatagtgacagggttgtagtgcttatacttagattgagtgctagaaatgttggtaatgaggaatccagcaaagatactgccaattgttaggtgtttaattgattttagtaatgttttctttaagcaactatatccaaaatatcacttcaacatgtgacattagccacatttcaagagcttcagtctcccctgtgctagacagcacagctctagatatctcttccctaagatctctgtgatacggacaagagacagggaaatacggggtagaagagaatggttccccagcaaaggccctacccttaagcctggagactctcagccctaagtaggaacaggcatttctgttaccttt

SEQ ID NO: 8311 - DNA, 454 bp, Homo sapiens
gagagctagcaccatgagcttcaacaccctgtacctactacaatttcagaagcagagctgcctgctacagcaaactggaaaatgtgatgccttcgtgaaatttcccgtcgctaaagatactctacacatgccccttgaccaagaaatagcacttatgggaactctacagatggatttctacacatctgaagtgatgcattggccacactattcttaatggcattgtttgtaatggccccaaattggaaatcacctaaagtccatccctacaggacttgtttaataaattatgaattatccatactttacatctattaaaaaatgaatacttgggccaggctcacatctgtaatcccagcattttgggaggccaaggcaggtggatcgcttgagttcgagaccagcctgagcaacatggtgaaactctgtctctaccaaaaatgcaaaaaaaaaa

SEQ ID NO: 8312 - DNA, 410 bp, Homo sapiens
cccaagacatacacaaggatgttcatagcagctttattccaaaatagtgaaaaacaaaacaatccccaaatgcacagcaatagggaaaacagacaaataaattgtggtatatttatacagtggaatactatgcaacaacaaaaaaggatgaagcataatactacacacagcgtgagtgagtctcacagacacagtgttaacagagagaatccagacacaaaagagcctatctatgcatgattccatttatatgaagttcaaagacatgcagagctaatctatggtgatagagataagaatggtggttacactgaaatgggaggatcgctcaaacccgggaggcggaggctgcagtgaaccatgatggagctgcactccagctttggagacagagcgagaccctgtctcta

SEQ ID NO: 8313 - DNA, 182 bp, Homo sapiens
tttgtgttatttttacttagttgccttcacacaagtatttttagtagagaacatacaggtaattaaagctgtgatcttaaacacgaaaaaagcatattaattcacagtaaactgctctttgggaagtcaaagttgctgtaataggactgctcagattcttaaaaaattaaatacagtgtata

SEQ ID NO: 8314 - DNA, 199 bp, Homo sapiens
ttgggcagtttcttaaaaaactaaacatactcttaccatacagttgagctccttggtatttacccaaaggagtgaaaactatatctgcctaaaaaccttcacattgttgtttatagcatggttggcaagtttataattgccagaacttggaagcagccaagatgtttttcagtaggtgaatgaaaaagtaaactgtgtt

SEQ ID NO: 8315 - DNA, 425 bp, Homo sapiens
tcttttttttcctgtggctttaaaatatttcatgatatggatacagggagcacagggaggggaacaacacacactggggcctattgggggagggcagtggggagagcattaggaaaaatagctaacgcatgccggtcttaatacctagctgatggattgataggtgcagcaaaccaccatggcacacgtttacctatgtaacaaacctgcacatctggcatgtgtaccccagaacttaaaataaaataaaataaaacttaaaaaagaacatatggaaagctggataatgccacaaaagggttaatgttagcaagcttgggatggaggcactatgcaccatcatcatgtatttttccatcttaagcagcataccactcctaaataaaacaaaatcattttgcagaaaataaaacacttcatgacag

SEQ ID NO: 8316 - DNA, 452 bp, Homo sapiens
aaaaaaatctcttacatatttttgaagtacttttaatttaccaaacatttattagaaattaaccactttactgggcacggtggctcacgcctgtaatcccagcactttgggaggccaaggtgggtggatcacgaggtcaggagtttgagaccagcctggccaacatgttgaaaccctgtctctactaaaaatataaaaattagccaggcgtggtggcgtgcacctgtaatcccagctactcaggaggctgaggcaggaaatcgcttgaaccggggagggagaggtggcagtgagctgagattgcaccactgcactctagtctgggcaacagagcaagactctggctgggtgtgggtgggggttggtgaggggaagttaaccactttatcaaaacatcttatgtacacaagtctatgtacctactgtgtactcacaaaaattaaaaagaaaaa

SEQ ID NO: 8317 - DNA, 307 bp, Homo sapiens
gtcagaggccactggaagagggtgtctttgggacatgcagtctttcctcacagtggggtagcgggaggatgtgtgggcacaggctggatccctgtttggtgtagggcttgtaagcttgcactctggtcagattgcatgactctggctctgaccacagctgtgtgacttcaggcaaattacttaacttctctgggcctcatgggtcttacttgcaagctgaggacaatcacagtacctacttcatgggctcgttgtagagattaaaggcacatgtgtatgaaaagcacttggcacagggctaggtgtg

SEQ ID NO: 8318 - DNA, 342 bp, Homo sapiens
gatccagtcagtggctctcctgctacccatggtctgaagttgcgggcacattgcacatactttcctggattagagaactctccaagccctccctcctgccctgcttcagagagcatgccaatttggcttctgcccatctccagcaatggttcctgtggatcctctgcctagcaacaggatttaccaatggatcagtggcagggcagaatagaaaggaaccagggatggctcccagaggatgttttaccttaagcaaccagagagatgaaggtgccacatagacagatggaaaactgttatttaggacacatttggaactcagctagtcaggggagcaaggat

SEQ ID NO: 8319 - DNA, 361 bp, Homo sapiens
atattttcagtgggcctttccagtcatttaatgaagaaattattttaaacataaaaatatgcttgaaacagctcattacagaatccacatcactataatcttatgcttggcctcaggaatgttatacaatggtttgagttcaaagtaaagaaaactgaattaaaacatgtagtagattttgtggggttttgtgtgtgtgtgtgcatgtgtgtgtttttaaaggtacaattgcttaaccagatattcctgtttctctgactggaatataaataaaaccagaacacaatccagaaaagcttgctttaccacaagcagatcaaatcggtattgggctacaaggaacacagaacaagaatctctt

SEQ ID NO: 8320 - DNA, 724 bp, Homo sapiens
gactacagaaagaaaactgaaaacaaatttgtacttaaacattgcaaggcttgttattgctgtatatgtatatattttgttgttgttgacttacaaatttgcttaaaaggttagtcagaattctaagacgttcagtttggtttcaccatgacagttatactgtacaaaatgggcacagtcagcctgacaaagtgacctgctgtaccctcagaactcttaacaacccctacagaagggacagactatttctagatgcttcttttaacaattgatgttttctgcttgtgtaactgctcaagctgaaaaagttagcaattaccacccagtgtgcaaaatagcattttattcgttctgaaaacacccctcttaaaccttaactaaaagagcacctactgtttcaggattctgttattaaataaattcttgttcactccctttgtgattttataacatttgaacatttctcttcttgccccccattttgtgggataaaaacaactctacttcaaatcctatggtatttaattatttccgagcgttattttgaggttttactttgtactagtaaattcctttacttcagtgattctcagccttggctatccattgaatttaaatgtgaagtattttttaaaatgctgaagctgggacttactcctccttcatgtttttaatacagccactttgactgtaaacaattaaatgtatgtgttcactgttactg

SEQ ID NO: 8321 - DNA, 236 bp, Homo sapiens
gtaatttgtatgcgccagaagttctgataatgtatgccgtcccctgcctcagagagtttagattctggaaaggagggcagatactgaacaagcccaagaagtctcacagagcagaaaggcagtgggctataaaacttttaaccagaggatttaatgtactcttggggagccagggaaggcttccttgaagagaagtacgatctctgtcaacagcacactctacagtgacatctaaa

SEQ ID NO: 8322 - DNA, 428 bp, Homo sapiens
ccattgtacttcagcctgggcaacaagagtgaaactttgtctcaaaaaataaaaaaagaaaagaaaagaattaggctgggcacagtggctcatgattgtaaccccagcactttgagaggccaacgcaggaggattgctcaagcccaggaattcaagaccagcctgggcaacatagtgagaccttgtctctacacataataaaaaaattagccaggcgtggtgttgtgtgcctgtggtcagggctactcaggaggctgaggtgggaggatggcttgagcctgggcagttgaggctgcagtgatggctgcactgcacttcaacctggggacagagtgataccctatctcaagaaaagaaatagttacttatttcattctgatcacattttccagtacaaatacatggaggtcccaagtgccaaagttaca

SEQ ID NO: 8323 - DNA, 399 bp, Homo sapiens
cagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgggatatacgtgtggggcttgaagtgtgcttgaagtggagatggggtttacgggggatcctggggggccccagacaacccaaggaccctg

SEQ ID NO: 8324 - DNA, 966 bp, Homo sapiens
  misc_feature (8)..(8): n is a, c, g, or t
tgcatttntgctactagggtgacgtgtcggggctatgtatgacagcttttcgtgtacctagggttggctgccagagtccctgtgaatcaagatttgggcatgttcttggtcaccatttcctgctacaccagaggtggccgaatcatctccacttcttcgcgttcggtgatggtgatggctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcacttt

SEQ ID NO: 8325 - DNA, 902 bp, Homo sapiens
  misc_feature (8)..(8): n is a, c, g, or t
tgcatttntgctactagggtgacgtgtcggggctatgtatgacagcttttcgtgtacctagggttggctgccagagtccctgtgaatcaagatttgggcatgttcttggtcaccatttcctgctacaccagaggtggccgaatcatctccacttcttcgcgttcggtgatgctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcacttt

SEQ ID NO: 8326 - DNA, 141 bp, Homo sapiens
aaaaagagaaaatagccttactctatacataataaactcaagatatgttacaaatttacatgtgaaatccgaaatactataatatttaaggaatagctaagtagaataacactgaaatttaacataatgaaacatttcctt

SEQ ID NO: 8327 - DNA, 629 bp, Homo sapiens
gcggaaatgagagcccagagagggtcaggcagcaaagcagtggccttgtggcccggagggaagaggggttacaagccagggccatcggaaactggaagggaagtcgccatgggtctggggtagagggaagggagaggcccttctaccctttgcccagactcctgagcaaggctttgccctgctccccacccttcccacacacccactcagctgcaggcctggccattaaatgtgggtgtctgacccataggttggaccatgagaccctagtggctgagggaggcctgggtgaggctctgggaggcaggactgaaaccagcaagggattcactgctgctcatgccctatggcacaacccccttatttatggggctgccttcccttccccagacctcgagtttccgttttcaagaacctttttcttcctatcttccttagggccccagggcctagcacacagcagtcactcacagtgtcctgtatttgtccagctaaatggagtgaatgaatcagtggtgaatgaatgaaaagggaaagtttctcaattggaagcatctagcccttgtggttttttttaaacctttttgaaatatatattgtaaaatagcattcacagaaaagctgaaaaa

SEQ ID NO: 8328 - DNA, 333 bp, Homo sapiens
ggatgatgaaaatattctggaattaaatagtattgatggtcatggtcacacagcattatgaatatacaaaaagccactgaattgtatactttaaaggggtgaattttatggcatgtgaattataccccaatttaaaaatatttgaaatctaaccataagggacatgttattcatatatgctcttcatgttcatgattcagccaatctattttaattttggaagtcttcaaactttaaatggatttctctaaattatcttttctggagtgaagttagaattattgatgtgagaggatatttcttctctgacatgttttatttacgtaggtcatt

SEQ ID NO: 8329 - DNA, 920 bp, Homo sapiens
ttagctggagtggcatataactcccactttcatacacagttggcatttctactgctgcctggagagacatcatagttgctatcaaggctggcaggcaccacagtttgtttcctttcaccctagttttctcatatttgtgtatagtcatttgtggagcattggtggcccagtatctctttaagcctttttttgtcattttttttagtgtcttatactacccacaatgtgggctgtacacctgtcgctctgcctccacccccacaaaccaaaagtaagttctgtggtaacaaggatgggaattatttctaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagaggggtaaggagcttcatgataattttcttctcctgggagctgtgataatagtttattcacccaaaatgtcatgggcattttttgaataccctgctctgtggatttgtaaaaccagccttgatagcaactatgatgtccttccaggcagcagtagaaatgccaactgtggatgaaagtgggagtaggcctagagaacagaaatatctaaaccacagaactcttggtaataacagtgtgaactctgttccttagactagtggagaggaaggaaagaaatggagtgggaaggcttggggccacttcatccttgtaaaatacagaaggaattgagatcagatgggctgttagtggcagaatgtgaaaacagttgtgtaccaggaaaaacataataaaagacaaaaaacttcatctcctacca

SEQ ID NO: 8330 - DNA, 522 bp, Homo sapiens
cctgacctagaccgtatacagaggagtagaagctgctgtgttaaagggctggcaggcaccacagtttgtttcctttcaccctagttttctcatatttgtgtatagtcatttgtggagcattggtggcccagtatctctttaagcctttttttgtcattttttttagtgtcttatactacccacaatgtgggctgtacacctgtcgctctgcctccacccccacaaaccaaaagtaagttctgtggtaacaaggatgggaattatttctaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagaggggtaaggagcttcatgataattttcttctcctgggagctgtgataatagtttattca

SEQ ID NO: 8331 - DNA, 468 bp, Homo sapiens
  misc_feature (17)..(17): n is a, c, g, or t
  misc_feature (19)..(20): n is a, c, g, or t
acaactttgttataaancnncctgggtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8332 - DNA, 4336 bp, Homo sapiens
  misc_feature (28)..(28): n is a, c, g, or t
  misc_feature (55)..(55): n is a, c, g, or t
ggggcaactgggctcagcaaagtccgcncggggtcacgccattctcctgcctctntgtatagtagagacggggtttcaccttgttagccaggatggtctcgatctcctgacctcatgatccacccgcctcggcctcccaagtcagtctagtctttattgtaatcagaaccataaaggcaaaatgaaccaatattcattatatatattacatgtaggtgaatggatattttgcatgttaatgaattttagtaaatagattgccagggaagccttgtcctgttttctttagtattttaaatcattggcagttcatcttcatttgaaaataaatgccaggcacatagtaagagctcagtaaatataggtaaagggaaggaggacgacgcaaactctttttaaaaatcagttgctatgtgcagttcttaattctgttttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8333 - DNA, 4406 bp, Homo sapiens
ctctacaggatcctctcttctccgaaaggcaacattgcaataggttgaatatagaggagttactgaagcacatgtatgaagtctgtcaggaaatgggcttgatggaagatttactgaagttaccatttacagacactgagcaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8334 - DNA, 4483 bp, Homo sapiens
ctctacaggatcctctcttctccgaaaggcaacattgcaataggttgaatatagaggagttactgaagcacatgtatgaagtctgtcaggaaatgggcttgatggaagatttactgaagttaccatttacagacactgagcaggtaattacttaccgatgtaaacttgtcagaaattcaagataaattggtagtttacaatctatcttgttcttttctaggaatgtttagtgaaatttttgcagtccagtgccagcgttcagaatcatgaattccttttagtgcaccatttgcagcgtgccaattatgtgcctgccttgaagctgaaccaaactctgaagattaatgttatgaatgatcgtgatcctcgtttgcgggagagatcactggctcgaaattctatattagaccagtatggaaaaatccttcctagagtccatcgaaaattagccattgaacgagctaagccttatcatctgtcaacatcatcagtttttcgattagtttctagacccaaaccattatcagcagttccaaagcaagttgtaacaggaactgtgttgacaagatctgttttcatcaacaatgtgttatctaaaattggagaagtttgggcaagcaaagaacctataaatagcaccacacctttcaatagttctaaaatagaagaaccatctcctatagtgtattcgctcccagctccagagctgcctgaggcattttttggaacaccaatttcaaaagcatcacaaaaaatttctagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8335 - DNA, 3716 bp, Homo sapiens
agcatggtatcaacccagagtgcccattacggccggggtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8336 - DNA, 5791 bp, Homo sapiens
  misc_feature (28)..(28): n is a, c, g, or t
  misc_feature (55)..(55): n is a, c, g, or t
ggggcaactgggctcagcaaagtccgcncggggtcacgccattctcctgcctctntgtatagtagagacggggtttcaccttgttagccaggatggtctcgatctcctgacctcatgatccacccgcctcggcctcccaagtcagtctagtctttattgtaatcagaaccataaaggcaaaatgaaccaatattcattatatatattacatgtaggtgaatggatattttgcatgttaatgaattttagtaaatagattgccagggaagccttgtcctgttttctttagtattttaaatcattggcagttcatcttcatttgaaaataaatgccaggcacatagtaagagctcagtaaatataggtaaagggaaggaggacgacgcaaactctttttaaaaatcagttgctatgtgcagttcttaattctgttttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaatgtgttgctacaac

SEQ ID NO: 8337 - DNA, 4202 bp, Homo sapiens
  misc_feature (28)..(28): n is a, c, g, or t
  misc_feature (55)..(55): n is a, c, g, or t
ggggcaactgggctcagcaaagtccgcncggggtcacgccattctcctgcctctntgtatagtagagacggggtttcaccttgttagccaggatggtctcgatctcctgacctcatgatccacccgcctcggcctcccaagtcagtctagtctttattgtaatcagaaccataaaggcaaaatgaaccaatattcattatatatattacatgtaggtgaatggatattttgcatgttaatgaattttagtaaatagattgccagggaagccttgtcctgttttctttagtattttaaatcattggcagttcatcttcatttgaaaataaatgccaggcacatagtaagagctcagtaaatataggtaaagggaaggaggacgacgcaaactctttttaaaaatcagttgctatgtgcagttcttaattctgttttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8338 - DNA, 5737 bp, Homo sapiens
  misc_feature (28)..(28): n is a, c, g, or t
  misc_feature (55)..(55): n is a, c, g, or t
ggggcaactgggctcagcaaagtccgcncggggtcacgccattctcctgcctctntgtatagtagagacggggtttcaccttgttagccaggatggtctcgatctcctgacctcatgatccacccgcctcggcctcccaagtcagtctagtctttattgtaatcagaaccataaaggcaaaatgaaccaatattcattatatatattacatgtaggtgaatggatattttgcatgttaatgaattttagtaaatagattgccagggaagccttgtcctgttttctttagtattttaaatcattggcagttcatcttcatttgaaaataaatgccaggcacatagtaagagctcagtaaatataggtaaagggaaggaggacgacgcaaactctttttaaaaatcagttgctatgtgcagttcttaattctgttttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaatgtgttgctacaac

SEQ ID NO: 8339 - DNA, 867 bp, Homo sapiens
  misc_feature (8)..(8): n is a, c, g, or t
atgtcctngctactgggaggctgaggcaggagaatcgcttgaacccgagaggttgcagtgagccaacatcaggccattgcacgcgacctcaaaaaaaaatcttgattcttttggctcactacgttcctttctgaaccaaacaatgagcctttattttctccagcgtcagaagttccaaggaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtc

SEQ ID NO: 8340 - DNA, 2696 bp, Homo sapiens
aaaaggaggatggtagggtgggggcagtttagttcccaatggatatttctggtttttgcagaaaaagtaggaaagggaagtgggatggtttacctctttgtcaggaaagttaggtaactattagtaaaaaacaattatacactttaaaatcctgcaattattttacagaaagcactaaaactgcatgcatgggaagatcactccatttcagatgtatttgttacacagtatcttgtttatgctgtgcttagtaggcatggttgaattcaataaaagcacacgtgaatgcattttatttaagacactatggctaataccactgtttacatataaactggcgtatctatgtgagaaactcaagtttgtgaaattctgtgcatctttgctaattgctgtgtttgatcattgacatttctgacatgccacatgggcctgcggggctgtcatcccctgggctgacaactggtactcggcccgtccttgtaatccagcagtattttttcatacatttgaaacatttagaggaaaattcagtaattgaataattgtttgtaaatattctgatcgaaaatgaaaaaattccccttaatgaaacctgaactctgcttctgattagcttatatgacttaaagcttcacttcagttcccttgaaaccattacatcttttataaaatgaaagcactaagcagtccctaaggtttttctcaacatgttgggaagccaattttattttatagcataatgtgtttattcttacttgatcatatctttttttttcagaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgtaaatttttatgtaaacagaaggtcttcaataagtaaagtaactccatatggagtgattgtttcagtccaggcaatttttctattttatattaagacttcatacatttatatatgtaaatatggcttattaatggaatgttaaataaaatgtatacttcacagtcgtttgtgtcttggatttttgaaagggaggggatatctgtttaaatagttttatatgctcattggtctcattttctctataattaaaatactagaccagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaatgtgttgctacaac

SEQ ID NO: 8341 - DNA, 3837 bp, Homo sapiens
  misc_feature (28)..(28): n is a, c, g, or t
  misc_feature (55)..(55): n is a, c, g, or t
ggggcaactgggctcagcaaagtccgcncggggtcacgccattctcctgcctctntgtatagtagagacggggtttcaccttgttagccaggatggtctcgatctcctgacctcatgatccacccgcctcggcctcccaagtcagtctagtctttattgtaatcagaaccataaaggcaaaatgaaccaatattcattatatatattacatgtaggtgaatggatattttgcatgttaatgaattttagtaaatagattgccagggaagccttgtcctgttttctttagtattttaaatcattggcagttcatcttcatttgaaaataaatgccaggcacatagtaagagctcagtaaatataggtaaagggaaggaggacgacgcaaactctttttaaaaatcagttgctatgtgcagttcttaattctgttttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgtcccccggccttctcagtgttcggagtttattcagcaaagctccatgaaatctcctttgtacctagtatcccgttcactgccctcaagttcgcaattaaaaggatcgcctcaggccatctccagggcttcagaattacatttgcttgaaactcctcttgtagttaagaaagctaaaagtttggccatgtcagttactacttctggattttctgagttcactcctcagtccatcctgaggtctactcttcgatcaacacctttagcatctccctctccatcacctggaaggtctcctcaacgacttaaagaaactagaatttcatttgtggaagaagatgtccacccaaaatggattcctggggctgcagatgatagcaaattagaagtatttactacacctaaaaaatgtgcagttccagtggaaactgaatggctgaagagcaaagataggaccacatcttttttcctgaacagccctgaaaaggagcatcaagaaatggatgaggggtcacaaagtttagagaaactggatgtgagcaaaggaaacagcagtgtttcaatcacatccgatgagactaccttagagtatcaggatgcaccgtcaccggaagaccttgaagagactgttttcacggcctctaagcccaaaagctcttccactgcactaactactaatgtaactgaacaaactgaaaaggatggagataaagatgtatttgcatcagaagtaactccttcagacctacagaaacaaatgggcaatttagaagatgcagaaacaaaggatctcttagttgcagcagaggcattttcagaattgaatcacttaagcccggttcaaggaactgaagcttctctttgtgcaccatcagtctatgaagggaaaatcttcacccagaagtccaaggtaccagtgttggacgaaggattaacatctgttgaaacctacacccctgcaattagagcaaatgacaataaatctatggctgatgtccttggtgatggtggaaactcctcgctcactatctctgaaggtcctattgtctctgagcgcaggcttaaccaggaagtagcgctgaacttaaaagaagatcatgaagtagaagttggtgtactaaaagaaagtgttgacttaccagaagaaaagcttcccatttctgacagccctcctgatactcaagaaattcatgtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatactagaaaacaccagttctgtggaacaagaattacagatcactacaggtagggaatcaaaaagattaaaatcatctcagctgttggaaccagcagttgaagaaactactaaaaaagaagttaaggtttcatctgttacaaaaaggactcctagaagaattaaaagatctgtagaaaatcaggaaagtgttgaaattataaatgatctaaaagttagtacggtaacaagtcctagcagaatgatcagaaaattgagaagtactaatttagatgcttctgaaaatacaggaaataagcaagatgataaatccagtgacaagcagctgcgtattaaacatgttagaagggtcagagggagagaagttagtccatcagatgtgagagaagactccaaccttgagtcatctcagttgactgttcaagcagaatttgatatgtctgccatacctagaaaacgtggtagaccaagaaaaatcaatccatctgaagatgtaggatctaaggctgttaaggaagagagaagccccaagaagaaagaagctcccagcattagaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagccaaaaacgttcattgcactcagtatcagaagaacgcacagatgaaatgacacataaagaaacaaatgagcaggaagaaagattgctcgccacagcttccttcactaaatcatcccgcagcagcaggactcggtctagcaaggccatcttgttgccggacctttctgaaccaaacaatgagcctttattttctccagcgtcagaagttccaaggaaagcaaaaggttgaagccgtcgacggcttcaacggaactttatggtatgtagaaattccaattactggtttgtcagtaggattcttagctctgtaaaacgccagtgcagtctctcctggcaccacctgttttaaagaatatatatattatcaatactttgagtctcacaaagttccgttgaagccgt

SEQ ID NO: 8342 - DNA, 1385 bp, Homo sapiens
gagtgactctgcaggatccccaggacagtcttaaaatggggatgattgaagtattgatatttctttttacagttactattttataatttatgcactttgattctgtgattcagatttctaatcagaaaatgtatttttttgtttttggctgttactatgttaaaattgaattatgggcatgtcattttgccatctttgtagtttcacaaattttgtgtaatctacctcaaatgaataatccaagtattggttaactataatgttggcatctcttattcggcaagcttaaaggctctttaaagtcttaattagtcaaagactaatccaggttagattgaccggttcactgctcacttgcaaccttatcaaagggtttgacaaagggaaatgtaaaataaatctgtttatggatattgagtgcatcttgtatgtgcctaatattgataggatgagatgtctgaacaaatttttataatattgctgtgaaggagcttgctattgaaccacagaaatcccttaatattcaggttttaaaactggcaaattctcacaggacctcaggcacagattattgaggttgggagagagtgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaatgtgttgctacaac

SEQ ID NO: 8343 - DNA, 887 bp, Homo sapiens
agaaaaggagaaaaacaacacacgccctgttctacatctactcactctctcccaacctcaataatctgtgcctgaggtcctgtgagaatttgagtagatgtagaaaaggagaaaaacaacacacgccctgttctctacagtacaactgtgtgcaattaagcaatggtacttgatgtaggctctaacactcatcaataaataagtgttgtaaaataatttataacaggtaatcgatagtgtgtaatgaatggactattaataattgattatctagaaacgaactgctttcgtgggcttttaatattttaatgtgaagcatatgcagtgtgctttctgcatttatttttctaccaaataatacagataatgagaaattggtgaaaatgcctacgcaaagtgttgacagtgtgaaagcagtgcgagtgcggccttttagtcaggttagtgatggatgttacgctgccttgttgaaaatttcactgactttgattttattacttttttaatgatagttatcaaacttgtatttaagctgcttgtcatttatggaatattgaacttatttaaatgaacttgttaaatgaataaagagctaaacataattcagtaaacaattcctttgcgcaagtagcacaataaacatggatgcaacgtatgtcaagttaatacttttttaaaccaacgcaatttggtgaatatagatgtgtggtacctgtttttaataagtgtactttttttcccccctccgtgaatgtagatcataagcaaacaaattgcctgttctaaatgaactttacatatattttaaatgaatgtatgtacttacgtataaatgtctttatatagcttgaataaaaacactgctcattaaaatgtgttgctacaac

SEQ ID NO: 8344 - DNA, 695 bp, Homo sapiens
cactgcaagctccgcttcccgggttcacgccattctcctgcctcagcctcccgagtagctgggactacaggcgcccgccaccgcgcccggctaatttttttttttgtatttttagtagagacggggtttcaccttgttagccaggatggtctcgatctcctgacctcatgatccacccgcctcggcctcccaagtcagtctagtctttattgtaatcagaaccataaaggcaaaatgaaccaatattcattatatatattacatgtaggtgaatggatattttgcatgttaatgaattttagtaaatagattgccagggaagccttgtcctgttttctttagtattttaaatcattggcagttcatcttcatttgaaaataaatgccaggcacatagtaagagctcagtaaatataggtaaagggaaggaggacgacgcaaactctttttaaaaatcagttgctatgtgcagttcttaattctgttttgcgatgaataattttctgactttttgaatgcatggtagcactttggattacattaatatacttgactgtatttgcatgtggctatcatagttaccagtgaatatagaggtctgattaaatgggatactaaattcttttgttttttcagtataactcaataaatgcgcattctgattacagactgctagatttggttgttcagcctgt

SEQ ID NO: 8345 - DNA, 510 bp, Homo sapiens
tgttttataagacagaatccctgactcccaggaatttatggtgtggaagaagaccaaagggatcaaaagttcaaaagcaaatggggttccactcccaggtaatgatgtcacctgatgaacatgtagaaggtcctttatatttctctcgggttattaactattcttgatacagcatcatatccaacaaaatgtagcttcacttttgcttacacgtgttctgttctcagaatgcccacacaagcacacgcaggtgaacgttcacagcagcatcaataatagtcaaaaagtgaaaaacaactcaaatgttcatcagcatgtgaatggctcaaaacaacatgatgtataattcaaaggactcttatttggcaataaacaagaaaagaagctcatctgggctgggtgtggtgcctcacgcctgtaatcccagcactttgggaggctgaggtgggtggatcatctgaggtcaggagtttgaaaccagccgggccaacatggtaaaaccctgtctct

SEQ ID NO: 8346 - DNA, 756 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8347 - DNA, 773 bp, Homo sapiens
tcgctagtcgagctgggtttgaatcggccgaggaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8348 - DNA, 793 bp, Homo sapiens
ggctggtactggtctggagtttatggatggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaagggggggcaaaaaatatctccctcggcgggggcccaggattttacgcggtccgcggctttttgttgtcaagtgtgggccccctatggggaagggggttattaaacgcgtagcgcgctgggcggctggttaaaacaggttcgtgggtgggacacaccgtgcttctgagctgtttggggagggcccctatctcgggggggccacttctggcgcactctag

SEQ ID NO: 8349 - DNA, 897 bp, Homo sapiens
gctggtacggtccggagtgtagggatcgcagccatttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaatctttctccttggctggatgcttcctgccttgaacatcagactcgaagttcttcagctgggggaatcggatggtctccttgccctcagtttggagcacctattgtgcgacctgtgtgatcatagcacacgtctcgccggtgccaggcaaggcagcgtgggacacggtcatgggagcacctcgtgggataaaatctccactagctgtgagaagtgagggaccgaataagctgtctgcgcgaaggaagaggggaccacccggaaatgcccgtaggatccgtacccaatgatagagggcagcggattgttagaaagggtgacgcgggggtcatggaaaccggcaaaaagatacgcaagt

SEQ ID NO: 8350 - DNA, 560 bp, Homo sapiens
gacggagtcttgctctgtcacccaggctggagtgcagtggtgcgatctcggcttactgcaacctccgcctcccaggtttaagccaagccattctcctgcctcagtctcccgagtagctgggatcacaggcgcccgccaccactcccggctaattttttgtatttttagtagagacggggtttcaccatgttggtcaggctggtctctaactcctgaccttgtgatccgcccgccttggcctcccaaattgctgggattacaggtgtgagccaccatgcccggcccagaccagctttaaaacaggtttcaataaatcctgcttcctgtcccttcctttaccatctggtggtgcatttctctagtaatctcctaaccagtctccatcctacttttccctccattcttgagtctttttcaacacaccagccactgatcatgtgaaaatataaattatgtcatccattcttctattcataacccaccgcacatgaccactcatctcagtacaagcaatattcttactgtgtccctaccagcccttatacaacctacaccacttc

SEQ ID NO: 8351 - DNA, 896 bp, Homo sapiens
  misc_feature (605)..(605): n is a, c, g, or t
  misc_feature (616)..(616): n is a, c, g, or t
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaaaaacaaaaaaaaanaaaaaaaaaanaaaaaaaaaaaagggggggggggggccccaacaaaaacaattactctcgcgaggggggagccccacataatatagcgaaaaaaccaaacgatatttttataaaaaaaaagaggggcgccaccaaaaaaaggggagcttcataataaaaaaacaagacgacagggggaggagctaaaacaacaacggccggcggagggaaaaaaaaaacagctcggagcaacactgtgtaagaaaaaaccacttacgtgggggggagacacaaagggggcacaaaccacaa

SEQ ID NO: 8352 - DNA, 793 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8353 - DNA, 749 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaattgtgtgcgggggccgccctgcggccctctcagaaaaagagctattctacaaaccccgcgcgttgggggcgcgcgggggccccagtggggtaagtggcaccgtgggctcaccagggtgttcccggagggaaaaccggggcccaggacacagggtgcgggggattctcccaaaaaaaaaacgcacgaga

SEQ ID NO: 8354 - DNA, 752 bp, Homo sapiens
ctcccccctcgcacatcaatacggctaggtcgagcccgtggtaaatcggccgaggggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8355 - DNA, 880 bp, Homo sapiens
  misc_feature (589)..(589): n is a, c, g, or t
  misc_feature (600)..(600): n is a, c, g, or t
ggctggtactggtctggagtttatggatggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaaaaacaaaaaaaaanaaaaaaaaaanaaaaaaaaaaaagggggggggggggccccaacaaaaacaattactctcgcgaggggggagccccacataatatagcgaaaaaaccaaacgatatttttataaaaaaaaagaggggcgccaccaaaaaaaggggagcttcataataaaaaaacaagacgacagggggaggagctaaaacaacaacggccggcggagggaaaaaaaaaacagctcggagcaacactgtgtaagaaaaaaccacttacgtgggggggagacacaaagggggcacaaaccacaa

SEQ ID NO: 8356 - DNA, 792 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaagaaagaacaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8357 - DNA, 560 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaatagccgaccccctacagatagccgaccctgggaaactctaggtcagc

SEQ ID NO: 8358 - DNA, 810 bp, Homo sapiens
  misc_feature (539)..(539): n is a, c, g, or t
  misc_feature (542)..(542): n is a, c, g, or t
  misc_feature (548)..(548): n is a, c, g, or t
  misc_feature (550)..(550): n is a, c, g, or t
  misc_feature (554)..(554): n is a, c, g, or t
  misc_feature (557)..(557): n is a, c, g, or t
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacaaaanaanaacaananaacnaanaacaaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8359 - DNA, 760 bp, Homo sapiens
ggacgcgtgggtcgacccacgcgtccgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaagaaagaacaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8360 - DNA, 787 bp, Homo sapiens
  misc_feature (516)..(516): n is a, c, g, or t
  misc_feature (519)..(519): n is a, c, g, or t
  misc_feature (525)..(525): n is a, c, g, or t
  misc_feature (527)..(527): n is a, c, g, or t
  misc_feature (531)..(531): n is a, c, g, or t
  misc_feature (534)..(534): n is a, c, g, or t
gcaggctggtaccggtcggaaagggtatgatccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacaaaanaanaacaananaacnaanaacaaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8361 - DNA, 998 bp, Homo sapiens
  misc_feature (1)..(1): n is a, c, g, or t
  misc_feature (727)..(727): n is a, c, g, or t
  misc_feature (730)..(730): n is a, c, g, or t
  misc_feature (736)..(736): n is a, c, g, or t
  misc_feature (738)..(738): n is a, c, g, or t
  misc_feature (742)..(742): n is a, c, g, or t
  misc_feature (745)..(745): n is a, c, g, or t
naaaagtttctgaacacattgtcttttataaaatattttttggacacacattttttttcctcccttttggaaaccccaaattcacaatatatgttagcccatttgtaatattttcccacaaattataaattctcttttcaaacccctcccggaactttttctggttttttctctttcaaaatctgtctaaaaattcaactgattcttctcttggatagtgccaataaacgtgtaaggcccatgaaagaaattcatttcggatagaaatttttctttctccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttacaaaanaanaacaananaacnaanaacaaaaaaaaaaaaaaaaaaaaaaaaaaaaaaaaaaaaaaaaaaacaaaacgctccgtgggcgggctcttttcgtcgtgggtgcgggaaagaaagggtggtatatgaaaagtggccaattgcggtctaatatgtgttctcctgtccaccccgtcttttttttcgcacggggggtggtaaaattggggggggcccccaaaaaagaggggccgcgatataaattcgaaaaaagccaggggttaccggtagaaag

SEQ ID NO: 8362 - DNA, 1111 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggtgaggaacgggcctggaagagcgcgggaggcgccgtgggctgaccccttctgcctagctgacctcaggtggtcctgagaatgcctcgcgccccgcagcgtagcggggagcagcagtgccggtttgggcatgtctggagggcgcgaacgacggggacagtgcccgggcgacagtcggggctgtcggcgttaggtctttccccacagccccaggatctcgggtctggtcctgtcaggccctccctctcctgtcgcctcctcgctgcgccgcctcctgccgacttctttagccgctctgagcccattttctcgttggttcactgggggatgcctgacgctgtcagcgacgaaacatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8363 - DNA, 965 bp, Homo sapiens
aagggctggacatggtggttcacgcctataatcccaaattgctgggattacaggtgtgagccaccatgcccggcccagaccagctttaaaacaggtttcaataaatcctgcttcctgtcccttcctttaccatctggtggtgcatttctccctgaaccctaaccccagctgtctctccttcctctcactcttccccctccttataactgaccctttacctcaagggttagcgtagctttggacctgctctgtctgctccgtggagcgtggattcctttaacgtgaggatgcggggcctcccacttgcctctgagtcctggctccctgagcggggctttctgctgcctgggaactgcaaggacttagagagcctaggggaatactgactccgaggtgccttctttcttgtgctctgtgtacatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8364 - DNA, 1174 bp, Homo sapiens
gacggagtcttgctctgtcacccaggctggagtgcagtggtgcgatctcggcttactgcaacctccgcctcccaggtttaagccaagccattctcctgcctcagtctcccgagtagctgggatcacaggcgcccgccaccactcccggctaattttttgtatttttagtagagacggggtttcaccatgttggtcaggctggtctctaactcctgaccttgtgatccgcccgccttggcctcccaaattgctgggattacaggtgtgagccaccatgcccggcccagaccagctttaaaacaggtttcaataaatcctgcttcctgtcccttcctttaccatctggtggtgcatttctccctgaaccctaaccccagctgtctctccttcctctcactcttccccctccttataactgaccctttacctcaagggttagcgtagctttggacctgctctgtctgctccgtggagcgtggattcctttaacgtgaggatgcggggcctcccacttgcctctgagtcctggctccctgagcggggctttctgctgcctgggaactgcaaggacttagagagcctaggggaatactgactccgaggtgccttctttcttgtgctctgtgtacatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8365 - DNA, 700 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatcctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8366 - DNA, 419 bp, Homo sapiens
  misc_feature (404)..(404): n is a, c, g, or t
  misc_feature (415)..(415): n is a, c, g, or t
aagatttcagagaaccgattaaaaaattaatctatgggcattttaatcaccatctaaaatattttatctaggatcacttatctttttttataaaagctcaaatcacaacattctcttttcatcagtccctacagccctgtgttggacaagcacagatgtcaaaaatacacttaaatatacgttgaatttttatccactagaataaaataagcagaatgatatgcattcttggcgatagtcttcactggaaaataccactgtcagcccaaacttacacaactgacttcaaaatcatgacctcttgatgtctccatggtgacctccttgggggtcactgaccctgcttggtggggtcccccttgtaacaataaaatctatttaaactttaaaaaaaaaaaatcctnttcggacccgnccgg

SEQ ID NO: 8367 - DNA, 870 bp, Homo sapiens
  misc_feature (579)..(579): n is a, c, g, or t
  misc_feature (590)..(590): n is a, c, g, or t
accacgcgtcggcattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaaaaacaaaaaaaaanaaaaaaaaaanaaaaaaaaaaaagggggggggggggccccaacaaaaacaattactctcgcgaggggggagccccacataatatagcgaaaaaaccaaacgatatttttataaaaaaaaagaggggcgccaccaaaaaaaggggagcttcataataaaaaaacaagacgacagggggaggagctaaaacaacaacggccggcggagggaaaaaaaaaacagctcggagcaacactgtgtaagaaaaaaccacttacgtgggggggagacacaaagggggcacaaaccacaa

SEQ ID NO: 8368 - DNA, 1544 bp, Homo sapiens
gcaggttagcattttattagataaaaacaggaaggagggtgcctacccacccctgcctgctactggctctgaagggcactcctcaacttccccaagaaagaggacgcgtctctgacactgtgatcatgacaggggttcaaacagaaagtgcctgggccctccttctaagtcttgttaccaaaaaaaggaaaaagaaaagatcttctcagttacaaattctgggaagggagactatacctggctcttgccctaagtgagaggtcttccctcccgcaccaaaaaatagaaaggctttctatttcactggcccaggtagggggaaggagagtaactttgagtctgtgggcctcatttcccaggtgccttcaatgctcatcaaaaccaggcatggggaaggccctggcaaactgctccacccgttgcctgaggttggccagacgctgacttgtttctgagtccttaagcaggaaggatttgaaatcctggagcttggcagtcttgctcttcacctctaagccaatgttgaccccttcatctataaagtccacaactctccggaagtcatcctcacggaactgtcgagaagttaaggctggggccccaagccgcaggccgcccggtgtgatggcacttcggtctccaggacaggtgttcttgttggcagtgatggatacaagctctagcacccgctcagcccgagctccatccaggcccttgggccgcaggtccaccagcaccaggtggttgtcagtaccacctgataccagtgagtagcctcgctctagcagggcatctgccatggcccgagcattcttcagaacctgcagggagtactcccggaacatgggggtgcaggcctgctttagggccacagctactgcagcaatggcatgattgtgggggcccccctgcagggatgggaacacggcaaagttgattcggtcctcaaatgtgtaagggatctcccggccagtcttggggtccacagccttcacccctttccggtagaagatgagccctgacctggcccctcgaagagtcttgtgagtagtggtggtgacgatgtccgcgtgcctccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaacttatatttgtgcatataaat

SEQ ID NO: 8369 - DNA, 951 bp, Homo sapiens
  misc_feature (644)..(644): n is a, c, g, or t
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaatacagcancacccttttgtccatttcgcttttaaatccgaccagccttatcatggggccccttttccaattccttttccaattccccctttaagaactcggttcaccattatttgacccgcttttatcaaacatccccttggtaaacctcttgcggtccccaactaaatccccttttttccaaacccccttttttcctctgggggtcatagccacaacgcccttatccgaaaggtctcttcccaccgtttgtgccaactctatattgcccaggaaaattttttaggcgaaaatttttgtgtaacatttcgggcaa

SEQ ID NO: 8370 - DNA, 564 bp, Homo sapiens
  misc_feature (549)..(549): n is a, c, g, or t
  misc_feature (560)..(560): n is a, c, g, or t
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaatcctnttcggacccgnccgg

SEQ ID NO: 8371 - DNA, 730 bp, Homo sapiens
accacgcgtcggcattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaaaaaaaaaaaaaaaaaactcgagactagttctctctctctcgagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaaaaaaaaa

SEQ ID NO: 8372 - DNA, 558 bp, Homo sapiens
cctgcttccccagctccagaacttccggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaactttaaaaacttatatttgtgcatataaat

SEQ ID NO: 8373 - DNA, 235 bp, Homo sapiens
cagtgagccgagatcacgccactgcactccagccggggtgaaaagagagagactccgtctcaaaaaaaaaaaaaaaaaaaaatcacaagataccactttatacccactaacatgtgctggtgatgatgctggagaaaacaataacacgtgttggtgatgatggtggagaacatagaatactgctggtaggaatggacaatgatacagctgctgtgggaagtggtttggcagttcc

SEQ ID NO: 8374 - DNA, 2027 bp, Homo sapiens
  misc_feature (1244)..(1244): n is a, c, g, or t
  misc_feature (1254)..(1255): n is a, c, g, or t
  misc_feature (1287)..(1287): n is a, c, g, or t
  misc_feature (1331)..(1331): n is a, c, g, or t
gatgtatatgtttgaagtgtgcgtgtagcattggggacaggcagaggctctgctcactggggaatgatgttctggtggaacaccccatggacttggagcttgagaagtgggctttggccaggccctggcactgaccacctaggaacagtcatcttttccaagcttctggttcctcttctgtaaggtgcgagtccctaaccacctttccaaagacagcatcctgtgcaagctgtcacgggagggggaagggccctggtgaccctcagggcctctagagcctgtgggcaagagctggccctccatgccaaggtgccaggcctaaccctggtgaagagtgacccaactgggcgactgcctgaggcctcagaggaggacaaggagaaggtgcacagcagcagggtgcacaccttgccctggcctctcctagggtagaggacggtgtgagcccccagaggctgtcatccagcctgagaggtttcttggctcttcctcccatgcccagggttctcccagactgcagagcaagatccaggctccacacaatgccagaggccctgcctctatcttctctctggccagcggccctatcgctaaccccacacatgaaggatactgctttggcatcatcgtttgtgagggccaggctggggaagggtggagagagtgtccttccctggggaggctgaacccagggagatggagtgacatgccccaaaaacacagcaagtgggactagaacccatgtctccagatggaaccccaggctcccactgctccatgctgtgcaggttacacctcccaccctgccgctctctccgggggcctcagtccacctcctgagcccatgtcctcagtccatgattggaccgggtccctgggtcccttggaggaccagccaagcccaggtccttctttgcttcttactccccaccccagtctccttgttcttcagtcttttgctttcccactggctcccttctcacacctcccatggctgtgcccatttctccttttaactctgtcaacttttggatcctatatttgaagcaaggcatgcatatatattttaaattttattatctctgttttgatctttttgtcataaaaaattcgtttttatttctaataatacttcctgccttaaagtctacatttcctgtttgaatgatgttcagtgtccattgtgtaaattctcatgtggtaatttcctttaagaaattattgaggggccaggcacagtggcncatgcctgtnntcccagcactttgagaggctgtggtgggatantttcttgagcccaggagttcgagaccagcctgggaagcatggcnaaaccctgtctctacaaaaaaaacacaaaaattagccaggggtgttggtgcatacctgtaatcccagttactcaggaggctgaggtgggaggatcacatgagcctgggaggttgaggctgcagtgagtcaagattgcaccactgcactccagcttgggtgacagagtgagaccctgtctcgaagaaaaagaaattattgagggcagggtggtggcacacgcctgtaatcccagcactttgggaggctgaggcaggaggattgcttgagctcaggaggttgaagctgcagtgagatgtgtttgcgccactgcactccagcttgggtgacggagcgagaccctgtctcaagaaaaaaaggagaagctactgaattgcagtaaaaccgtgtgcttctatgaggggataaagtatttacttgtggctgggcacggtggctcacgcctgtaatcccaacacttcgggaggccgaggcgggaggatcacctgaggtcaggagttcgagaccagcctcaacatggagaaaccccgtctctactaaaaatacaattagccaggcgtggtggtgcatgcctgtaatcccagctactcgggaggctgaggcaggagaattgcttgaacccaggaggcggaggttgcggtgagccaagatcgtgccattgcactccagcctgggcaacaagagcgaaactccatctc

SEQ ID NO: 8375 - DNA, 957 bp, Homo sapiens
attaagggcctgttgaggattaagggcctattgctacagagtggtaatcttgagattgattttgtcgcaatttgaatgattttattcatttcaataagggaaagaaagaaggggactagaaattagtgagtacaaacttcaaggcctttgcacctgctgtttttgctacctgggatgctctttctccacatgtcaatttcctgtctcctcctcagcagttagtgtcagctagaatgtgctctcatcagagaactgttccacgatagtcttttattttttttttttttttgagatggagtcttgctctgtcatccaggctgtggtgctatcttggcccactgcaacctccacctcccaggttcaagtgattctcagcctccccggtagctgggattacaggtgcatgccaccactcccggctaatttttgtatttttagtagagatggggtttcaccatgttggtcaggctgttctcaaactcctaacctcaagtggtccgcccaccttggcctcccaaagagctagaattacaggcattcttatctaaagaagtatttcctcttctcactcccactttctattatttcagcctgttttattgcctttataatacttacaaatcattgtctgaagttatcttgtttatagctttatagtttattgtcctcttcccctattggaatgtacttcctaaatcctcaagcctaggacagtacctggcacataataggtgcttaaaggtgaatgaatgaataaatatgctaggtatatctatacatgatttcacggaatccccacagctacctagtaaagtagacgttgttctgtctgtttcatgtttgaggaaactgaggctcagagaaagtaaatcacttaggccaggcacagtggctcatgcctataacccagcactttggaaggctgaggcaggaggatcatttgaggccaggagtttg

SEQ ID NO: 8376 - DNA, 90 bp, Homo sapiens
tctttttcaaatctatcttttcattgttaatcctaattgtagtaactatgcctaatttttaaataatgtacaaataaatcatgctttagt

SEQ ID NO: 8377 - DNA, 373 bp, Homo sapiens
agggaacatcttgagaacctcgattaagcatgaaaggacaggtccgcggtcctttatatgaaaacttggagctcaagtatgttttggaatttcaaatattcgtatttcagaaagatggagaaacgtttaatctatatacatgacatcttcgtgacttcttcatagcacctcaaatcaaatattacattaaaaattacataaagttccctggagtaaaatacatgactatttacactaacctatataaaattataaatgagcttttgtcagtcaaaattgggtaaggtttcaaccagccaaatgaaataaaaagaaaacataagcctttggttttcaatctctttggatatctggaccatggttgaagaattat

SEQ ID NO: 8378 - DNA, 509 bp, Homo sapiens
tcctgcctcctcccatgacccaccttcctgagaccccccgctcacacatcagttgcagtgccctgggggtgcagtggtggctgaggcagacatggctcctgtccccagtggggaggtggatggtgctcatggtcagcgccgctggaggggagctccgagtggaaagggagacgaaggtggggccctgagcccatcatgagtctgggctcctccgtcgtgctgctcagcatctccttcccatttctcttaccacactgcagcctctgtgagagcaaggatggcgtcttagtcgtgagttcccaaaaccttgtacaatgccccgggtagatgtttaatgagtccaacacagaggctttatccaaggccatgagaaaaatgcccttgcacctcagttacctctgtgacattctgacaactacacagtgaagcagcctcagtgccctcaggccctgcagtatagtccacccctttcccggggctgccggggtggggtttggtgcaagcaagac

SEQ ID NO: 8379 - DNA, 373 bp, Homo sapiens
actgaactgtacacttaagaatggtaaagatggtaaatattatgttttctatatttcaccatgattttttaaaagtttaaacaaggccgggcatggtggctcacgcctgtaatcccagcactttgggaggccgagacaggcggatcactaggtcaaggagatcaagaccatcctggctaacacagtgaaaccccgtctctactaaaaatacacaaaaattagccaggcgtggtggtgggtgcctgtagtcccagctactcaggaggctggggcaggaaaatggcatgaacctgggaggcagagcttgcagtgagccaagatcctgccactgcattccagcctgggagacagagtgagactctgtctcaaaaaa

SEQ ID NO: 8380 - DNA, 772 bp, Homo sapiens
ttgtttttaatataatttatgatctacctttaagagtgcttttaatcagcacttctgtagaaccagctgaaatgccagtgtgtatattaacattataatttaggtactggatcaaacatgtatagctggacttttcctgaggaaaaaagttgacctgaccagtgtatgaaattcaaacactgtataggaacaaggtaaaagcacaggtaggaattgctgaataattacctttagaccagcctgaacaggagacttcccacgagggtgagctcatttaatggttcctaaaactcaatcttgtggatgtcagtggtcatgcttgattatttgcagcagtgttttatgaaaagcagtagaaatgcattgggaggctgcagagaaagaggacaataacgggttttacttttgtaaatgaaatcccttcggtatgagacaagtatgttttttgctgctctgcctaagccactgaaaagggagatgtatgtggatgttagtgtgtgagtatgtgtgtactgttcatgtaggcacatctaaaaactgctgtgcactatggctgatgaccaacaagagacctaaaataaaaagagaaaaaagatgctcattggctttggaaaggaagcaattataaatacagtttaaaagattaacctattttccatttctccactcacctattttcaagaaatgtaataaaacaccaagctctttaccatatgtttacaacatttctaagtaaatataagtcttttaaatgacagacaaaaaaaaaaaa

SEQ ID NO: 8381 - DNA, 528 bp, Homo sapiens
tacatcgatgattctaggaaaataaaagtgaatgaccacatcaagcaaagtccatccttgagaaggcaagaggggatgtgaattggaatgcaagggaggactggtctttgaaaaagggatggtcctttcctccacggcattgaaagagaaggcaggtgcagatggccacagttgcctgcaggtgttttagtggtgagaagacaagacttcatatctaagagcttctcgtatttttaaagaagtcagaggttaagtaactggctgagactataataagagtgtgctctacgggtagaggttgagaaggcagaaaacacttaaaatcattatcttggggagttgggaagagatcttggattgtttggcagttttctgtgcctgtttgagatttttgatcatgaattttaaatgaaaccagtcacagttgtatgattttctgcagcaagacttagctgctgaagtgcaggcaggggtacgtgatagggtttagttggtgccaggattttgctaggattgtaaaaaaggaaa

SEQ ID NO: 8382 - DNA, 388 bp, Homo sapiens
aaataaaatttactggaggccattgttttggactaagctcctgtactagaccccagagtggagtcactcatgttaggtgccacgtaatcaaactgacccttaaaacagtcagctttaaaaaaaacaaacagatttacagcaaccagcagagaaggtcccagtcaacctgagctgatgtgataaggaagtcccctctgctttcatcctacaagaaaagtaactttgaaatgcccagtctactctttgttccttgtttctgttccccttctgccactttgtgcccccaaagacaaccccctcttctcattgggatgtctttttctatttcatcaatgggatgctgcctaattaatgaatcaataataaaagccaatgagtcaactcaatt

SEQ ID NO: 8383 - DNA, 466 bp, Homo sapiens
tgaaagaaatgcttttagtgtttcatcacaaaatgatgtttactataggtttttggtagacgaagttcccttcctcattgctgtggtaatggaactgtaatatgattaacagatagacaccaactgacacagagaatataaagtttaatgacaaaggaaaaagaaacttacaaagatggtttcataaagcaggagataatatattactctctcagataccagtagaactttccaggccctccaaagtttcccatggaaatacaactgtggagagtactacaaacgtattacttactttgtaatacaaagcaagtattataccattttaatagaggttttgtatctccttggccccaacttctgaagaatcttctgtgcctgccagctctccaggtgcaaataaccagtgcaaaacacccttgatgttttattattattattattatttctgggacaattgagtaaa

SEQ ID NO: 8384 - DNA, 168 bp, Homo sapiens
cagcatcacttgacttcctccttctactttccttccttctgcaggccagtctgtagttggctgatgtctgagaatatcacgacttttctgattcttagcagaaaagatgtggttttctaggaagcttctggtgcagcgagccctggttggggtggggctgagggcagt

SEQ ID NO: 8385 - DNA, 815 bp, Homo sapiens
gagtgtgcatccattactttgttgattgatatttgggtcatttccaggttttggctattgtgaataaaactgccttgactattcctgtacaagtctttgtattaaggaacatacgttttattttctcttgaggaagttcctagcaataagattgctgggtcatatggtaggtatatatttagctttaaaagcaactaagtgctttccaaagtgactgtacaatttaacattcctacctgaaatgtaagagaattccagttgctccacattcttgtcaacccttggtagcatcagtctctttaagaattctaatggatatgtaatatggactataggtttaatttgcatttctctgttgactaatgatgttgcacaacttttcatatgtctatcaaccattcttgcatcttcttttatgaaatgtctgttcaaatcatttgtccactttttattgtgtcattttattcagttgtaagagttctttacatattctggaaacaagtcctctgtcacatatataggtactttgaaaatctgtgctttgcctttacatttttttaatggtaactttttaagagtagatagttttggttttgatgaaattcaacttatcagtttttcagttatagtatgtatttttatgacccacctaagaagcatctgtctacccagagttgcaaagatatcccttttcttactagaaatattatagttttatttaccattgcttctatgatacattttaagttaatttttgtgtattaaatgaataaaaagttgaagttcaaaaaaaaaaagtcgacgcggccgcgaat

SEQ ID NO: 8386 - DNA, 373 bp, Homo sapiens
gaggctgaggcaggagaattgctcgaacccggaggttgcagtaagccgggatcgcaccactgcactccaactcgggcaacagtgagagactccgtctcaaaaaaaaaaaaacaccccaaaaactgctttgatgaaagctaaagagtaaactgtaaataaaaattaggcctaattttttgtttgttttttgtttttgtttttgagaccaagtctcactctgtcgcccaggctggagtgcagtggcatgatctcggctcattgcagcctctacctttcaggtttaagtgattctcatgcctcagcctcccaagtagctgggattacagatgcctgccaccatgcccggctaatttttgtatttttagtagagaca

SEQ ID NO: 8387 - DNA, 430 bp, Homo sapiens
attattgaaacaaaaacagcaacataacatactagaacctgtgagatacagcaatagcattgctaagagagctatttatagcaataaatgcttacatcagaaaagtagaaagagctcaaataaacagtttaatgatgcatctcaaggaactagaaaagccagaacaaaccaagccccaaatttagtcgaagaaaaagcaataaagatcagagcagaactaaatcaagtagagactgtaaaaataatacaaaggatcaacaaattgaaatttgtattttttgaagtgataaaaatcaactaacaacaaaaaaagaaaaaattatctaggtgtggtggcacatgcctgtagtcctgggtactcgggagactgaggcaggaggatcacttgtgctcaggagttcatcctgagtgacagtgtgagacctgtctg

SEQ ID NO: 8388 - DNA, 302 bp, Homo sapiens
acctgctgcatcaccaggctgggtgaacggacacaattgccagaactcacagaatagaagtatcagcaccgaaacctcacaggaaaaatgctccacgagtctcacagaacagccacactggctccttcattgtcttcagctccacaaccctcagatttgaacagcggtagcaccacctcctctccaggtcttcagccccatgtccctccctgaacaatcccttctcatgaaattcagcagtcaagaaatctgcagcggaagtaaatgaataaacgttttgttttcaaattgaacctctttta

SEQ ID NO: 8389 - DNA, 409 bp, Homo sapiens
acctgctgcatcaccaggctgggtgaacggacacaattgccagaactcacagaatagaagtatcagcaccgaaacctcacaggaaaaatgctccacgagtctcacagaacagccacactggctccttcattgtcttcagctccacaacctaagacatcagtgggagcaccggctcctccctggacctccagctcaacgaatctcatagacttaaaaggcagcacctgctcctccccaaggctccatctccaccaccctcagatttgaacagcggtagcaccacctcctctccaggtcttcagccccatgtccctccctgaacaatcccttctcatgaaattcagcagtcaagaaatctgcagcggaagtaaatgaataaacgttttgttttcaaattgaacctctttta

SEQ ID NO: 8390 - DNA, 834 bp, Homo sapiens
tgacagctggtttcctctctcctgggtggtcattctgaggagagtttattcctgttgaagaggccctcacgcagtccagcagataacacaaatgccccacatccccacaggtctccggggatttaggatgggcaggcagacagaattccagaagttgattctgggagaatcagttcagttttcccagaagtgcctcatgggcaaagcagtttctgccaagctataaaacggctcacgctggcccctcctacagaggaaaaccagtgtctcatcattgtgcaggtgctgccccacaaaacaggtgtgtttgtgcctttggataacctgtcaccaaacctacagttccttaccatgtgcctgcccttttgtgcagctgcatacaggccccagagccaagcagaagaaatgtaacccttgcccaggagtggatgtgaccacgaccatgcttctcttaaatgtaaagcaagcagagcatccaggggtttcctgtgtcctccgccccttccccgctcgcaggagcgggaaagcttccctccctcctttcacccacctgaatttgcagcgggcagacctgagccggcctaaattgggatgcacagatacttctgtgtctgtccccttattcttaaaacaggactaaccacagccccgacacacagcatccgtagagtgattggatgaggttgcattcagggaatgctcgtcacagtgtggaaacacaaaaatgcttcctgcattgatgctgctatggtttttataaataaaacatgttagaataggaatagatcttgttaatactctttttaaaactttttttgatgcccgacacacata

SEQ ID NO: 8391 - DNA, 327 bp, Homo sapiens
tggacaaggagatgcatgtagttttcctgcctgctgacaacagcagccattctgcagcccatggctgagcagtaattttgactttgaagttttagtatttaagaaatatattttgtgccaggcatggtgtaatcccagcatattgggagaccaaggtgggcggatcatgaggtcaggatttcaagaccagcctggccaacatagtgaaaccccgtctctattaaaaatacaaaaattggccagcatggcagaatgtgcctgtagtcccaactactcaggaggctgaggcaggagaatcacctgaacccaggaggtgaaagttccagt

SEQ ID NO: 8392 - DNA, 749 bp, Homo sapiens
ggagactcagtgctgacctgtgacttcagacttttctgagcctcagtttccccttttatactacaggggagttgagctggagtctattccataaagcaggccatgatgacactgctcagagtgaagtgggtggggtctcagggaccacctctcctcctgccttccacagaagctgctgagaagcctctgaggacctgcaggctctgcagcacctagggacctcaaaaacccctctccctgcactgcactagggacctcaaaacccctctccctgcactgcactagggacctcaaaacccctctccctgcctgcaccagggacctcaaaacccctctccctccctacacttttgttcacactgcctcctcccggcttttgtcccctccaagtcagagccagattgagattcctctctggcagtcagtttcctgagctaccgtctcttccaaacagcaggtgtaagactcccacattctgctccaaccatgctgtctgggggcatgggaacaccagattcttaggcctgcatgacccttctctctccagtcctctgttcccctgtgtgcctggaagtgccaggttcaaaagacccatagaggcctgtcccgttgtgatggcaagaccatgaccatggacaggctgacagtggctcttttcggagctggactggcagagcctgcgcttgtggtgcctggctcggggctgatgcctgctggggatgccttcctgtcccaggaggttctggctg

SEQ ID NO: 8393 - DNA, 393 bp, Homo sapiens
gcttaaaaaaaaaaaaaaaagtaagaaaatatttgttaactttgactccagtgcaaagaacttttatttttgtgttcacagcacttttaaagcaaattagctaaatttgaatctctaactcccagattgctaaaaacaaaaaaacccataaccctgatccatttacttccagagaaatacacattggcattctctctggaatgttttttgccatttggatttagcctataactgataaggactcagcctggcacctggaaggaatgccttcaaatgtgaccatgtggggatgaaattatgttatacttgttgttgttgttgttgtattaagtggttattaactggaccaaagaaaaaatctgtagagaatatttcctaatgaaatttgtctcc

SEQ ID NO: 8394 - DNA, 770 bp, Homo sapiens
tttcacttttctttttttttttttaacaaggatacttcatagggggtaacatcaggaggcacatgtctgccttgtcccacttttagtgatgctaagagtgatcagagggttcaaatggtaacagcctcagctctcttatcaacttttcatctaaagacttgatagtcattccttgaatcaattattacatgaggggctgtaagtggtgattttctaatgctgctggtccaactacatttattagttggaattcttctctcaccaactaaacctattttgatactctgaattacactttatacaggaaaactaggataactatttaattctttccttttaccttccaattttcaaaataaagtactggtgccttagttacatcagtaactgatgtagagtttatttccaactaaatttaacagataccaaaactgaaatatctatttacaaaacatttaaacaaaggagaggagagattctgtgagcaatccaactaacatataaagggtataagccagtacttccgatttgtccagtgatgtattaataaaagtccagccaggcacggtagctcacacctgtaatcccagcactttgggaggccgaggcgggtggatcacgaggtcaggagtttgagaccatcctggctaacatggtgaaaacccgtctctactaaaaatacaaaaaacacacacaaaaaaatgctcaccatcactggccatcagagaaatgcaaatcaaaaccacaatgagataccatctcacaccagt

SEQ ID NO: 8395 - DNA, 630 bp, Homo sapiens
ccatccatccatccatccatccatccatccttccatccaaataacttaattaataccttcagttagatactgcaaaatatgtgctgggagccatggaagatagaaaaaaagtaattaatggggtgattatggcataatttctattattggctattcttaaataatttttatatcttcaaataactttaaaagataggcaaatcaatatctatttgtgtttctaagttaaaataaactatttagtgtattactttttataattctctgctttttttaaaaaaagaaaacccagacatttcatttagctgacagctgtggatgttcgttgcattagatagattttttatcttaatatagaaatcttactgaaccaagaaagttttgcagaatttctgaaggccgaatattcagacttaaataataacaatgtaggcttgcttttcattaacttgattaaaatttaaagttggagttgagaaaagattggaacaattgacattaaatatatatgatgcttatgaatctgtgtttggcactattttcacttatttggtttaccttatcaagactagtttctgttaagccactttaccttattcagtataaataagactgagtaccaaaattcta

SEQ ID NO: 8396 - DNA, 345 bp, Homo sapiens
tattaaatggtaaaaagatgtgcttttcattttgaaagagcagaggggcagttttttacccaacaaactaaataatataaaaagggctttgttttttcatggatcaggcctctggtatctatattcaactggtgctttttaagcgtatacaagtaatttttatcaacctggttgttgtttcatagcgttgatgtgtagtatctctttataggatgcaattttgagacacaatctgcaccttactctcaattaggcaagtatacctattgtaattatcttttacttacgtgattggtgtgctcaatttccttcacaaaataaatggcggcaacttgtcttatgtca

SEQ ID NO: 8397 - DNA, 566 bp, Homo sapiens
ttggattttaattgtgaagctgcagcaagtttacacacaagagtatcagattaacacagaaatctggaaatgttagaactttggttggaaatttcctgtgacccttgggaatgacagctttagagccaggattgtgtgattcacagtatagtcttccacagtctcctgtctcttttataaggtgtcctatgagactaataatatctttcttaggggactgttgagaaggtggaattttgcactgttctatagtaaatgctcagcaggtggtaattaagaagaaattatgtttctggaaatatttgtagatgtaagttatgatcagcatttagcttgcctatccattgttctggttcaaagagttttgcatgttagccgatctcaaaactaaacatcttccattataaagccatcaaatcattctttattgagagtttatcaataagcatttaacttaattaactccctcttgagtaactggataaatgaaaaaaccatattatatatcagaatttgaaacaagaactgaaaactcctaaaacatggaaccaaactcaaccaggtat

SEQ ID NO: 8398 - DNA, 446 bp, Homo sapiens
tctcgaactcctgacctcaggtgatccgcccacctcgtcctcccaaagtgccgggattacaggagttcttcaagaccaccttggccaacacagtgaaacccgtctctactaaaaataaaaaaaaaattagccaatcatcgtggtgtgtgcctatagtctcagctacttgggaggctgaggcaggagaatcgcttgaacctgggaggcagaggttgcagtgagccaagatcgtgccactgcactccagcctgggcaacagagtgagactccatctcaaaaaaataaaaataaaaaataaatgcaaaatataaagtcaggttgtaaacagatacattctaaaacttatctctggctgggcatggtggctcacgtctgtaatcccagcactttggcaggccgaggcgggacacttgaggttaggtgttcgagaccagcctggccaatat

SEQ ID NO: 8399 - DNA, 560 bp, Homo sapiens
taggcagaatatatataggctggtaaaaaaaaaattgtgtttcttttaaccattctgtacccacagtggcatgtaaatattaagtttttttttcttctttttatgagacagagtctccagcccaggctggagtacagtggcacaatcttgactctgcaacctctgcctcccaggttcaagtgattcttgtacctcagccacccaagtagctgggactacaggcatgcaccaccatgcccagctaactttttgtatttgtagcagagatgggcttttgccatgttggccaggatggtctcaaactctcggcctcaagtgatttgcccatctcagcctcctgaagtgctgggattacaggtgtgagccactgcacccagcctaaattatttcttaattgctaatttgttaatgtgaataaaatattcttgtactagaataggatagggtggtagttcttaatcttttttgagcgaagctgtggattcttcttagaataatgcacacaaaaacactttgcttttaattcaaggctttcatagatcctgggttaactaaagacc

SEQ ID NO: 8400 - DNA, 313 bp, Homo sapiens
taggcagaatatatataggctggtaaaaaaaaaattgtgtttcttttaaccattctgtacccacagtggcatgtaaatattaagtttttttttcttctttttatgagacagagtctccagcccaggctggagtacagtggcacaatcttgactctgcaacctctgcctcccaggttcaagtgattcttgtacctcagctactcaggaggctgaggcagggggatcacttgaacccaagaggcggaggttgcagaaaacagagattgcgccactacaccccagcctgggtgacaagaatgaaactctatctcaa

SEQ ID NO: 8401 - DNA, 681 bp, Homo sapiens
tggcttaaacaacagaaatttacttctcttggttatggagtctggaaatccaagataagggctgggcgcggtggctcatgcctgcaatctcagcactctgggaggccgaggaggatggatcacctcagttcaggagcttgaagtgagccgagatcgcgccactgcattccagcctgggcaatagagcgaagactccatctcaaaaaaaaaatcaaaaaacctcaagtaaagaactatcagcggacattacattaactgataaaatgatgaacactgacatcagcaacaagccaagaataatccacaatcatctctattattctgttattgttttagaggttctggctattagagtaagatgaaaaaataaaaacttttttggaaaaaatatttttccttgcagatgatatgattgtattcttagaaaacctcatataccactaaaattaaaaaaaaaattaggtgtgatatggctggtcaaaagactagtatatcagaatcaatggctttttctcccccatagtaccagtaatcacttagaaatggaagccaggcacagtgggatgtgccggtggtcccaactcctccggagtatgaggcaggagaaatacttgagtttgaggatacttagctatgatcgtgtcactagcctgtgcgatatagcgaggctctgtctcttaa

SEQ ID NO: 8402 - DNA, 1117 bp, Homo sapiens
cgcccagcgcagccccggccgctgggcgcacccgtcccgttcgtccccggacgttgctctctaccccgggaacgtcgagactggagcgcccgaactgagccaccttcgcggaccccgagagcggcggcgcgactcaccgcggaggcgcccggacgcgtcaatgtcccccagggcaaggcctgaaccaggtcgcgagggtctgtctcccgtctggggagctgaactgcccgagacactgtcgcagtcgcggggacttgtctggagcggcggggtctgagcccaagtcggaagccgccgccgccgccagcgtcccgtgcgcctgccgccccgggaccagccgcgaaacttcttctcgggacggagacagcgctcgccgcccgggccgaggcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggaggacctcctgaggcttcgggcaggagctggtgcacacctggaggagagtgctggtgaatggcaggtgtgtgcctcagtgtccttgctgccagggtgtcagccctgcttcaccactggccgtttgtctctgtcccctccactggcctcttgaagcacagagaccctccgggtactttccttcctctgggcttccactcatgctattccctgctccctttttctacctggagacccccattcctcctcctcctctgctgccctcacctccacctgggccctcccagctcccgggagatggctgaaccccactccccacccgctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatggagaaaaaaaaaaa

SEQ ID NO: 8403 - DNA, 834 bp, Homo sapiens
cgcccagcgcagccccggccgctgggcgcacccgtcccgttcgtccccggacgttgctctctaccccgggaacgtcgagactggagcgcccgaactgagccaccttcgcggaccccgagagcggcggcgcgactcaccgcggaggcgcccggacgcgtcaagtgcgtactttcaaccgtaaatgggtgctgagcgtttaggggtgcggggcaactccctaactcgtggggccctggccggccctgccgcggcgtccgagaccttctgatccctcgctgcgcgcggcgcggggttggcgacttgggctcaggggcggcggggcggggaggtgccttgacctagggacccagaggccgggagcaagtctcctttcgccttggactgcagtgtcccccagggcaaggcctgaaccaggtcgcgagggtctgtctcccgtctggggagctgaactgcccgagacactgtcgcagtcgcggggacttgtctggagcggcggggtctgagcccaagtcggaagccgccgccgccgccagcgtcccgtgcgcctgccgccccgggaccagccgcgaaacttcttctcgggacggagacagcgctcgccgcccgggccgaggtaggagctggctgggctcggtagagcgcgggcgaatcgctttcggcagcgaaggaacgtgtcgggagaagccaactgcaggaccagggccccagcgggcgcgcagagacgcctgccttgggcggaggtcccccctccggttttcgtggctctggtagggccctctgtcccgtgagctcctcactggacctgaggctacaggcttcagcaggtcaagcgcc

SEQ ID NO: 8404 - DNA, 2154 bp, Homo sapiens
ccagcctggtctctcccccttgcgtcagtgctcctaagctgcccctcaccactctgggtaggggtctttcaggtgggctagggaattctccttggaagtccccttgtttgctcccctccatcagggcacctctgagttagccaatcatcctcttttctggcctcttttttgcggggaggagagtagagagagaagcctcctactcggcaggtctctgagaggaggtttgggggggcttctgaggttgctcctcctgggcagagtcaaggggtgttgagggttccaacttttactggacaatctctcaagctctgattccctgatttctgggaggtgtcagtgtagggcttgtgtcctgccccacccacacagcatttggtgcaggcacatgggatggttccccaagcccttttcccacagttagtttcagaaaatgcataagccacctaaggctgggagagcctttctgtgctggctgagatctggtggcatgtgcatgcatatgtgtgcaagtgtgtgtgtgtgtgtgcaagtgtgtgtgcgcatgtgcatgtgtgtggaaagtatggtctgggtggctgtaagactggcccctcttgtcccctctgcaggcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggtgaggacagacccaaggtccaggcaatgctggcctttggaacacagaacctggctcactgactcccactccagttgtcttttccctctgcctctggagcaaccctctctcctccagagcaacccctgtccctccttcctacctctctctagggctgcacccccagctcaccttagacctggcccttcctacctgttgcccctactgtcttgtcccatcccagtggtcaggagggagagtactggccaaaggcccagctccacctgtgacttaggggagtgccaggcatcacccagaggtcccggccctcgggggcctggcaggctctgctgtgggggaagcagagttagaactggggctgcttctcctgtcccccagcctggctgggcctcccccacctccctttctgcctgccctcttacaactccagcagggggcgggcaggggaaagaaaaggagggacaagttggatggggtccatttggtgtccaggaacaacttggagagaggcggggaggggacaggcagcagggccctggcagagccaggggagggctggcctttggatggccttctgatcccaagcccatcctcctggggcagtcttcccttgaaagggagggtttggtgaaccctggtgcggacccccccgccggacctcactgccccagtgcggggcgtggtaggcgggtttgcaatgggtacagcctctctctccattccagtagagcagctcccagggcccagagaggctgtcactgagacttccctctggggtggggtgggttctggtggccctgtgttcccctgcaggaggacctcctgaggcttcgggcaggagctggtgcacacctggaggagagtgctggtgaatggcaggtgtgtgcctcagtgtccttgctgccagggtgtcagccctgcttcaccactggccgtttgtctctgtcccctccactggcctcttgaagcacagagaccctccgggtactttccttcctctgggcttccactcatgctattccctgctccctttttctacctggagacccccattcctcctcctcctctgctgccctcacctccacctgggccctcccagctcccgggagatggctgaaccccactccccacccgctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatggagaaaaaaaaaaa

SEQ ID NO: 8405 - DNA, 1704 bp, Homo sapiens
cgcccagcgcagccccggccgctgggcgcacccgtcccgttcgtccccggacgttgctctctaccccgggaacgtcgagactggagcgcccgaactgagccaccttcgcggaccccgagagcggcggcgcgactcaccgcggaggcgcccggacgcgtcaagcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggtgaggacagacccaaggtccaggcaatgctggcctttggaacacagaacctggctcactgactcccactccagttgtcttttccctctgcctctggagcaaccctctctcctccagagcaacccctgtccctccttcctacctctctctagggctgcacccccagctcaccttagacctggcccttcctacctgttgcccctactgtcttgtcccatcccagtggtcaggagggagagtactggccaaaggcccagctccacctgtgacttaggggagtgccaggcatcacccagaggtcccggccctcgggggcctggcaggctctgctgtgggggaagcagagttagaactggggctgcttctcctgtcccccagcctggctgggcctcccccacctccctttctgcctgccctcttacaactccagcagggggcgggcaggggaaagaaaaggagggacaagttggatggggtccatttggtgtccaggaacaacttggagagaggcggggaggggacaggcagcagggccctggcagagccaggggagggctggcctttggatggccttctgatcccaagcccatcctcctggggcagtcttcccttgaaagggagggtttggtgaaccctggtgcggacccccccgccggacctcactgccccagtgcggggcgtggtaggcgggtttgcaatgggtacagcctctctctccattccagtagagcagctcccagggcccagagaggctgtcactgagacttccctctggggtggggtgggttctggtggccctgtgttcccctgcaggaggacctcctgaggcttcgggcaggagctggtgcacacctggaggagagtgctggtgaatggcaggtgtgtgcctcagtgtccttgctgccagggtgtcagccctgcttcaccactggccgtttgtctctgtcccctccactggcctcttgaagcacagagaccctccgggtactttccttcctctgggcttccactcatgctattccctgctccctttttctacctggagacccccattcctcctcctcctctgctgccctcacctccacctgggccctcccagctcccgggagatggctgaaccccactccccacccgctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatggagaaaaaaaaaaa

SEQ ID NO: 8406 - DNA, 1341 bp, Homo sapiens
ccagcctggtctctcccccttgcgtcagtgctcctaagctgcccctcaccactctgggtaggggtctttcaggtgggctagggaattctccttggaagtccccttgtttgctcccctccatcagggcacctctgagttagccaatcatcctcttttctggcctcttttttgcggggaggagagtagagagagaagcctcctactcggcaggtctctgagaggaggtttgggggggcttctgaggttgctcctcctgggcagagtcaaggggtgttgagggttccaacttttactggacaatctctcaagctctgattccctgatttctgggaggtgtcagtgtagggcttgtgtcctgccccacccacacagcatttggtgcaggcacatgggatggttccccaagcccttttcccacagttagtttcagaaaatgcataagccacctaaggctgggagagcctttctgtgctggctgagatctggtggcatgtgcatgcatatgtgtgcaagtgtgtgtgtgtgtgtgcaagtgtgtgtgcgcatgtgcatgtgtgtggaaagtatggtctgggtggctgtaagactggcccctcttgtcccctctgcaggcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggaggacctcctgaggcttcgggcaggagctggtgcacacctggaggagagtgctggtgaatggcaggtgtgtgcctcagtgtccttgctgccagggtgtcagccctgcttcaccactggccgtttgtctctgtcccctccactggcctcttgaagcacagagaccctccgggtactttccttcctctgggcttccactcatgctattccctgctccctttttctacctggagacccccattcctcctcctcctctgctgccctcacctccacctgggccctcccagctcccgggagatggctgaaccccactccccacccgctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatggagaaaaaaaaaaa

SEQ ID NO: 8407 - DNA, 1516 bp, Homo sapiens
ccagcctggtctctcccccttgcgtcagtgctcctaagctgcccctcaccactctgggtaggggtctttcaggtgggctagggaattctccttggaagtccccttgtttgctcccctccatcagggcacctctgagttagccaatcatcctcttttctggcctcttttttgcggggaggagagtagagagagaagcctcctactcggcaggtctctgagaggaggtttgggggggcttctgaggttgctcctcctgggcagagtcaaggggtgttgagggttccaacttttactggacaatctctcaagctctgattccctgatttctgggaggtgtcagtgtagggcttgtgtcctgccccacccacacagcatttggtgcaggcacatgggatggttccccaagcccttttcccacagttagtttcagaaaatgcataagccacctaaggctgggagagcctttctgtgctggctgagatctggtggcatgtgcatgcatatgtgtgcaagtgtgtgtgtgtgtgtgcaagtgtgtgtgcgcatgtgcatgtgtgtggaaagtatggtctgggtggctgtaagactggcccctcttgtcccctctgcaggcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggtgaggacagacccaaggtccaggcaatgctggcctttggaacacagaacctggctcactgactcccactccagttgtcttttccctctgcctctggagcaaccctctctcctccagagcaacccctgtccctccttcctacctctctctagggctgcacccccagctcaccttagacctggcccttcctacctgttgcccctactgtcttgtcccatcccagtggtcaggagggagagtactggccaaaggcccagctccacctgtgacttaggggagtgccaggcatcacccagaggtcccggccctcgggggcctggcaggctctgctgtgggggaagcagagttagaactggggctgcttctccactggccgtttgtctctgtcccctccactggcctcttgaagcacagagaccctccgggtactttccttcctctgggcttccactcatgctattccctgctccctttttctacctggagacccccattcctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatggagaaaaaaaaaaa

SEQ ID NO: 8408 - DNA, 1086 bp, Homo sapiens
ccagcctggtctctcccccttgcgtcagtgctcctaagctgcccctcaccactctgggtaggggtctttcaggtgggctagggaattctccttggaagtccccttgtttgctcccctccatcagggcacctctgagttagccaatcatcctcttttctggcctcttttttgcggggaggagagtagagagagaagcctcctactcggcaggtctctgagaggaggtttgggggggcttctgaggttgctcctcctgggcagagtcaaggggtgttgagggttccaacttttactggacaatctctcaagctctgattccctgatttctgggaggtgtcagtgtagggcttgtgtcctgccccacccacacagcatttggtgcaggcacatgggatggttccccaagcccttttcccacagttagtttcagaaaatgcataagccacctaaggctgggagagcctttctgtgctggctgagatctggtggcatgtgcatgcatatgtgtgcaagtgtgtgtgtgtgtgtgcaagtgtgtgtgcgcatgtgcatgtgtgtggaaagtatggtctgggtggctgtaagactggcccctcttgtcccctctgcaggcccagcccaataggaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggaggacctcctgaggcttcgggcaggagctggtgcacacctggaggagagtgctggtgaatggcagctagtcatcctcttcagcggtcctcccagagctgtcctcagcatggcagcctccacagcccctgggtgtcacccccggtttcgtgtctgcctcggactccagacctgcccctcccaggctggcccagatggatcctctacagtgactaacccaaaccagcaccaggcagggacccaataaacctttgtgaatggagaaaaaaaaaaa

SEQ ID NO: 8409 - DNA, 539 bp, Homo sapiens
gacagcggtgtcgccagcagtgggcgccgaaaaactagcttcttggaggacgacttgaatcccttcgactcagaggaactggccctccacctggacagtggggggatccgcaagcgcacctcggcccaatgcagtgatggcatcacagactccccaatccaaaagcgcaaccgaatggtctaaactgcctcattggttgcctgccgccatattgcttgagagtgaactcaaccgtcgacatgcttgtctaaaggttactggagaccatttttcttcccttctctaagttaaacaaagatttctaacaattttgccataaagaaactttaaaagtattccagaagaggcttcatatgactctgactttccaaaaaatataatcctagcagagaacaaatatgtagtagttagcaggatcatttaaagcaaacgtatctggtcaaggcaggagtctgatttatcttgttcacagttatattcctcagcacctagcacagttccaggtgctcaataaatgttcattgaatgaaaaaaaaaaa

SEQ ID NO: 8410 - DNA, 271 bp, Homo sapiens
tggccctggtttcctagccgtctgctgccccggagtgtccggcagtcgccgcagccccaggagctgccggaattaggcctcgtttctcgggtgtgaacccccatttatgcacaggggttcctagacgggctcgggggcctggctggccggcttctccagctcaggagatttctcacctgctccttttcaattctttgacaaactggttttgggggtggcccgcccctattccttccagcctgtgggagtctccgcagccacccttgcctga

SEQ ID NO: 8411 - DNA, 648 bp, Homo sapiens
caaacccacgaaatagcccttgtggttgtggcttttagtaccaggaagtcaggaggagacggttgctaaatgtagttctatctggtactcgagtggggcacaatttttaaaagccaaaagtcaaagggtctcaaatgaactctgagttaccatctttggactgacttttaatataaagctgtaatccttaaatctgtgtcagtagtcccacctactatgtcactttaattggatgaatgcgttaatgaaaagtttgttttcaaacctcactaaactgctacttaagatcacagttaatgtgagtcctgcttaatttggaaagcatttaaaaaatggaaaagtttcttagggaagcaaaaattttgcaactctgcctacaaggtacagtaattggctaggttcttttgaagagcagtgttgactagagttaaggaaaagtcagttgtgaaaaatggacatttttaatagcaaaatgatgtgctttactgtagaaacaggaggaagggtgcattatcctggggaaaatgaattcttcttcagttatattttatgctgctctactttattgcaaaacgctaatattaaatgaatcaagaccacctccccttcccgctttatgaaaataaatagaagtatagaagataaaaa

SEQ ID NO: 8412 - DNA, 227 bp, Homo sapiens
ttgaaagctcagccagggcctgaccccagacgcagtgctcagagaccacagtgcttctagaggcccacaacagtattagagcttcttttaaaatcagaaggaaggaaatgaacctctaagatcaaatagtacatttgcctttataccagtgcagctatacaatatgatttctaatatttgggaggagaagggacccataaggtaaagcaccttggcccatggaagtc

SEQ ID NO: 8413 - DNA, 472 bp, Homo sapiens
tatgccaggatggcaagaatgttgtgcttcatcacttgattttaaaagcagaatttttaaaaattccaggaaacaaagatagtacatttgaaatggtctcttttattcagtaaaatggaatgttgcagtgctctcttttcaaagcaaaaagtgagtttctttttattttaaaactgtacaggctgggcacgatggctcacacctgtaatcccagcactttgggaggccgaggcaggcggatcacgaggtcaggagatcgagatcatcctggctgacacagtgaaaccccgtctctactaaaaatacaaaaaaaaattatccgggcgtggtggcaggcacctgtagtcccagctactcgggaggctgaggcaggagaatggcgtgaacccgggaggtggagcttgcagtgagccgagattgcgccactgcactccagcctgggcaacagagtaagactctgtctcaaaaaaaa

SEQ ID NO: 8414 - DNA, 437 bp, Homo sapiens
gggtatgtggaaactttactattttccctatttttctgtaaatctaaaaccattctaaaaattaaatttactttttaaaaagtttcttaaaacaatgaaatgagtttgaccaatgcaaagctgaagaaagaagataaccatgaaatctaggattcaaagcaaaggttaataaaattttgattatgtgacaccatgacggatatacagtacaataataatatccctatgtttgaaataaggtaggtatcaaattttaatttacaaaccaacacaaattattaaaggaataaaatattctaaagaaaataggctgagtgcagtggctcatgcctctaatcccagcactttgagaggccatggtgggaggatcccttgagcccaggagtttgagaccagcctgagcaacatagcaagaccttatctctactaaaaattaa

SEQ ID NO: 8415 - DNA, 487 bp, Homo sapiens
gttcatattgtaggagtgttgaagaggtacataactgaaagatacttaattctgaaccaagctgaatgttaaaccataaccgtgttcaaaaaatgaaattagttgtaaattagttgtggtataaaaattgcttccagaaatgttgtataagcttggtttaataaatatatatggaactctggatcccacagagaacacacattcatttctaggacacatgaaaaagtttataaaaattgaaaacacataggccatgaaggaagtctcagaaactcaaaagaatcaatctttatattttgaaaatgtgtgttttggccaggtgcagtgactcacacttgtaatcccagcactttgggaggccgaggcacgtggatcacttgaggtcaggagttcaagaccagcctggccaacatggtgaaacccccatctctactaaagatacaaaaattagccgggcgtggtggcacgtgcctgtagtcccagctac

SEQ ID NO: 8416 - DNA, 348 bp, Homo sapiens
gagagggagggagggaaggggcattcggcgttctgagcctggcttcaacccagctctccctgccctctgccccccgcctaccccttccggctccatcacacggcactcaagaccctaaggagcatctgaggctctgggtcccaggagtgcaggtgtttggcccaggatcctcccgggaaacttctcctccccacgactggcagctcccaggatctcttgcccatctccaaattccagcaccacccactgtgctcaccacccagccagccacacccctgggccagccctgcctctcccagacgagctgtctctcaccctgtcctccgggaaggcccctgaagcccctcc

SEQ ID NO: 8417 - DNA, 293 bp, Homo sapiens
ggttgctctcctatcgtaaatctcttttaacgttgagcttcaatcttaatgctcaatcaacatatttttcttgatctcatcaaaatccatagcaataacaactcttaaccatgaccctcagatttttatatccaaccaaaatcattcttttgagctagagacctatccccctgcccatcagttatgctcatgtatgtcacatagttaattcaaaatcagtatatatgagatcaaaaactgccttctaagcaattcttcctccttctctagctcattgaaagacatcatgtgcc

SEQ ID NO: 8418 - DNA, 417 bp, Homo sapiens
actcctatggctctgcattatttgctttgttcttagaaaaggatcttaccctccccaactagactgtgaaatcctggacaactagacacccaacccattctgagaaacacttgaacacttggtgattggtaacaaaatgcatccacatgtagccactatgtaaaacaagtgagagtcacgactgctgccctataagagtctatgtggccaggtgtggtgattcacacctgtaatcccagcactttgggagactgaggtgagaggatcacttgagcacaggagttcaagcccagcctgggcaatgtaacgagacctctatctataaaaaatgaggcaggagttggcaagaggtcaagactgcaatgagccatgatcctgccactatactcctgcctgggtgatgggagaccctgtctc

SEQ ID NO: 8419 - DNA, 436 bp, Homo sapiens
tgtctgtgcatcccatgacccaatcaagttgccataaaattaaccatcacaggaagaaaataataatttcagaaatatatccaaatacatatgagaatttattttatgataaatatagcatctcaactcagtaggcaggaaagatagagtattcagtatttggtaaatgctgttgaggaataattgagcaggcatttgggggaaaaaaattggatccatcattcagaccttacacaggaatacattccagatatattacatgtaaaaactaccaccatgaaagtactaggataagcataggaaaatccttttatgcctgcaaatgtataggctttgtggcctatacatttagtctgtttctattctttggattaaaaaattgacacatttccttgacttatattccttctagaaaaacaaatggacataacattga

SEQ ID NO: 8420 - DNA, 362 bp, Homo sapiens
aatccaaacaccaggttaataaggtggtgaagattctgagagttgtaggagatgttgtaataatcctagttatatttctttctcatataaaaatgaaggaacaggatttattttatcaactctatagaagatttgtttaatctcctatagagagtacatgtgtatctttacaatcaggattaaaaatattattttcaacaattggcaggctaaatttgtactagaaagctaaatttaggccttagataaatgtagtaagtatattttactcaatgtacatttatgcagatttttcaatagtggtaagttgtagtgccttggttcaagacactgaaacaagtaagcagaaaatctcattttca

SEQ ID NO: 8421 - DNA, 314 bp, Homo sapiens
ccatattggctaggcttgtctcgaactcctgacctcaggtgatccacccacctcagcctcccaaagtactgggattataggcataagccaccacgcccagacactatctgatttttatggaaagtttcccaatgcctgaactagtcaatagcccttggatgtcctggcagtctcttacatcccacatttatattaaccatgcctatcatgatgtctgacccatcaaaagccctgagaccagagagggcacttatccaatgggggctaacttatacaatataaacaacccatgctgtatcctgtcctgaaaacat

SEQ ID NO: 8422 - DNA, 863 bp, Homo sapiens
accccgggaaccgttattggccgggtcacaagcccgcccgcccgctgctggagccgcgaccatggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggcctacatgataaggcacctctggggctcatggacacacccctgttagacacagaagaggaggtgcactactgcttcctgcccctagacctggtggccaaatatcccagcctagtgactgaagacaacctgctgtggctggctgagacggtggccctcatcgagtgcgagtgcagcgagttccgcttcattgtgaattttcttcgctcacagaagattttactaccggataatttctccaacattgatgttttagaagcagaagtggaaattctggaaatccctgcactcactgaagccgtaaggtggtaccggatgaacatgggtatgtcgccaggaaaccttggctccc

SEQ ID NO: 8423 - DNA, 708 bp, Homo sapiens
aggctgaggcaggagaatcgcttgaacccaggaggtggaggttgcagtgagctgagatcgcaccactgcactccagcctgggcaacaaaacgagactctgtctcaaaaaaaaaaaaaagtaagtcacatactgtttttcctgatcttcacactagaattggtacatagttacttggtttagattctcaagatagtactcttcattatctaacagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggtgaattgggataggctgtccctccctaaagcccacaccaactttccctctcctcaccctaacagaagtggcttccatccagagagcagagagtgcctgatttctgaggcagtctctgtcatctcctttgatcttctgccctgccacaggccctctccatggctgcttgcctgctggaaccaacattctcctccacactcactcctctgcattctggcttcatgtgggcaaggcgaggtttcattccactccctcctattcatcagggaatgccaccattcttttgagtttcctccaaccaccacacacagaatgtccctaaataatcactgtctgatgggtg

SEQ ID NO: 8424 - DNA, 643 bp, Homo sapiens
accccgggaaccgttattggccgggtcacaagcccgcccgcccgctgctggagccgcgaccatggtacggagcccgctctggcgggggcgccaaaagcaccaaagcggcgaatgggggccgctgtggccaaggattggggctaagtggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcaggtaagatgctcttgttttctgggagtggtggatcagtaacatggctttacatcactaaatattgtttcctgttatatattggttgctgagatgaccctcttaatgggcaaatgtaataagtgtgttaaagtaataaataatttcctcattagtataggggtgagtaaaaaggaaaaaaaagtaataaacaatacactga

SEQ ID NO: 8425 - DNA, 946 bp, Homo sapiens
accccgggaaccgttattggccgggtcacaagcccgcccgcccgctgctggagccgcgaccatggtacggagcccgctctggcgggggcgccaaaagcaccaaagcggcgaatgggggccgctgtggccaaggattggggctaagtggaggagtctggcatggctcatgaatcagcagaggacttgtttcatttcaacgtagggggctggcatttctcagttcccagaagcaaactctctcagtttccagactccctgctgtggaaagaggcttcagccttgacctcttcagaaagccagaggctatttatcgacagagatggttccacatttaggcacgtgcactattacctctacacctccaaactctccttctccagttgtgcagaactgaacttgctgtatgagcaagcattgggtttgcagctgatgcctttgctgcagactctagataacctgaaggaagggaaacaccatctacgcgtacggcctgcagacctacctgttgctgagagagcatctctgaactactggcgtacatggaagtgtattagcaaaccctcagaatttccaattaaaagcccagcctttacaggcctacatgataaggcacctctggggctcatggacacacccctgttagacacagaagaggaggtgcactactgcttcctgcccctagacctggtggccaaatatcccagcctagtgactgaagacaacctgctgtggctggctgagacggtggccctcatcgagtgcgagtgcagcgagttccgcttcattgtgaattttcttcgctcacagaagattttactaccggataatttctccaacattgatgttttagaagcagaagtggaaattctggaaatccctgcactcactgaagccgtaaggtggtaccggatgaacatgggtatgtcgccaggaaaccttggctccc

SEQ ID NO: 8426 - DNA, 321 bp, Homo sapiens
caaaggcttgtatcccacatggaagtggtcacgaagggaagaaagaatggactgagcttgtgaggcaggaagaatgaattttccatgatttaagaaccacttgagccggctgggcgcggtggctcacacttgtaatcccagcactttgggaggctgaggcgggcaaattacgaggtcaggagacccagaccatcctggctaacacagtgaaaccccgtctctactaaaaatacaaaaaaactagccgggcatggtggcaggcgcctgtagtcccagctgctggggaggctgaggcaggagaatggcatgaacccaggaggc

SEQ ID NO: 8427 - DNA, 324 bp, Homo sapiens
cagtgaatacctttggaagtgagggcaaatgaggtggcactaaaataaagatgcattggtggaaagtctgtttactgagcagttataccctccagcttcctctattcccagcaataagagtactgtccctcccgacactgacaaaagactggagctgaatagttgtgaaaagatagaacacaatctctggactagtggacacatgtcaaaattgaagatggggatgccacagataaaataggaaattaattacatggacacctgccagatgctgatactatagctctcctccttctcagctcccaggaggctgtcaggccactt

SEQ ID NO: 8428 - DNA, 417 bp, Homo sapiens
ccttgttctcgagcctgatttctccatgctgtgggcatgttgattcccaccttctgtgttcccagcctcgttttctatttgctacttaccccagtgccagtcctgtaactttgcctaaaatgctggttaattcccctaacatggctcagcctcagcttggcagccagagtcaggcagccgatgaccttcagagggatggcagtgcctccaccaccaaaggggcttttagacctgattgagggtgtcactaaacctctaggactagatgatatagcctagaatttttaaaagaaagccaatgcaaaatcattattcctgaccccacgtatgtggcactgttggttgcacagcagatggctggccagcagctccactcgtaagaactccagggcatgttggaggcagatgctgggagac

SEQ ID NO: 8429 - DNA, 508 bp, Homo sapiens
agatgtggggtgaagtctgagggaagccaggcttccagggatcctctcccagtggaattaagggcatgttttattccccagcagtgggctgtgacaacatatatgaaatgtcgtctcccagggaagcttgttaggcgcacttggcacctagggtttttattgagagcagtcacgtaggtttcttctgcttggcacataacaaaatccaaacttccaaaaggaaagcaggcattcagagtaaactgtgttgtttgtatatccagtctaggcacagtaaactactcttctcagttgtgggaatgatgggacccctcaaaatccaagttctagaaattagtcaagggtcaaccttgtaagtagacttttgaaaggatagcagtcatttctgcataatgaaacactgtatcttatatattaagaaagatattaataaaactaatgctactgtagtatttatatgttgtatttatgagtaatattttcataataaaattattgaaaaagaatg

SEQ ID NO: 8430 - DNA, 387 bp, Homo sapiens
gaaactaaactgtttctcactttttcttccctcaattctacatatatttattttgcaatttttgttctttgttttcatgcattaaaagagtagttctcatttggaatggtactgatctcaaagggaatgtttaggaataaagcgtggggcaattttggttgtcactatgggggaagagaactatctactagcatgtagtcagcaaggaccagagtttctaaacctcctgcagtacacaggtcagtgtgcacagtggactagttgtcccacctaaaatgccagttatgcctctgttgtgcaacattccaacaaaatgtctccttataaagaaattgatatttaaagagttgaagtttgaaaaacaattaaaatatgcctgctttgcta

SEQ ID NO: 8431 - DNA, 468 bp, Homo sapiens
tcataaatcataactatcttgaaagggaaaaaagatatttataataatataaatgacataaatgactcagcacaagacctggtatatacaacataccttgaaatcgtacattttctccaccccattctctaacacaattctcattttgagaagaggttcaagaatatttatggtttaaaaatctggaataagcatagattatacacaacaatattttatgtattttatttttccccctttgttcttatttatttatttatttatttatttacttttatagagatggggtctcactatgttgaccaggctggtctcaaactcctgacctcaagagatcctcccatcccgttctcccaaagtactgggattacaggcgtaagccatcatagctggcccacaccaatattttaaataacgcaaagaaaataggctgaaaaaaaagacaacacatatttgataaagggtgag

SEQ ID NO: 8432 - DNA, 490 bp, Homo sapiens
ttacaagcaatgacaccccagaggtcttcatttctaataccattttccaattaaaggagcagggggtccttggagaaatgtctgatttctagaaatggggcaagaaatatgagccttatactgctggcaattaaggaagtgctcaaaaacccaaaacagaacaaagaagccacacaacacatagatgggggtgcatcaaatgggcataggagccaaataaaagagttgtaaatggcccaaactggaacacactgagcagaaaaataaaagtctgtcatgacttaaattataaaataaatatgcatgagtccatactgatgtaaataaatgatcagataaattagtaaatggagaagagacaaatctcccttacagaagaattccaaatgatagaggtagatacgtactttaccctcaagaggtgaagtataactctctatttctaaaatgtgggttgggtagagtgatttccatctgaagattgcaatat

SEQ ID NO: 8433 - DNA, 448 bp, Homo sapiens
aagcccaggtggtttgaagagtgagatgtctgggtcagagggaagtggaagtggacttttaggttaagcgagaagtctccagggcagagctgatttaactctgaaaatagctggaggaggactctagtgggtgcgtttacccctgctgtggccggggttggatacttattattcccctttcaactttctgtatcttattctttctaggcctgattgttactctctttcagaaacaagagggcgggggtggtagctcacacctgtaattgcaacacttagggtggcagaggctagaggatggcttgaacccagcctgggcaacatagcaggaccacctccacaaaaagaaaaaaaaaagaaacaaggacactctggggactgactcacgttaattaaaatcacgagactggtattaaaaactcaggaagtcattattaacttacagcaa

SEQ ID NO: 8434 - DNA, 442 bp, Homo sapiens
tgcctcagcctcccgagtagctggattacaggcgcttgccaccacgctctgctaatttttgtatttttagtaaagatgggttttgccatgttggccaggctggtcttgaacttctggtctcaagtgatccgccctcctcagcctcccaaagtgctgggattacaggtgtgagccactgcgtcaggccaatacacatcttctagtttatttaaagtgctagatagtatttcattgtataaaaagaccacagtttattcattcttttgttgatagatctttaaattgtttccattatttttcccttacaaacaatgcatgataaatgtttttgtatgtgtctccttgtgagagttatatatctaggtgtgacatcactgggttctatcacaagtctttggaagtaatttttatgtggatagtgcaacaatatgactagttactt

SEQ ID NO: 8435 - DNA, 206 bp, Homo sapiens
gccaccacacccagttaatttttgtatttttagtagagacggggttttgccatgttggccaggctggtctcgatctcctgacctctggtgatccgcctgccttggcctcccaaagtgctgggattacaggcatgagccactgtgcccgaccaggataacaattcttagacatctatgtgactaacagcaccaactatatatgaggc

SEQ ID NO: 8436 - DNA, 4161 bp, Homo sapiens
ggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccccgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaaggacaagtgaattaatgtatgatgttcttgatgaatccttacgaagagctgagttaaatcacaatgtcacatatgctattttgtttgaatgtgtgcatacagtctattctatttatcctaaatcggaattacttgagaaggctgccaagtgcattggaaaatttgttctgtcacctaaaataaatctaaaatatttaggactgaaggctcttacctatgttatccaacaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagatttcttcaagttatgagttgggtattaggggaatattcctacctcttagataaggaaacgccagaggaagttatagctaagctctacaagttacttatgaatgactctgtgtcttcagaaacaaaagcctggttaattgctgctgtgaccaaattgacatctcaggcgcactcttctaatacagttgagagattaatccatgaatttaccatatctttggatacttgtatgagacaacatgcatttgaattaaaacatttgcatgagaatgtggaacttatgaagagcttgcttccagttgacaggagttgtgaagacttggtggtagatgcttctttatcttttctggatggttttgtggctgaaggactcagtcagggtgcagcgccttacaaacctccccatcaacgccaggaggaaaagctttctcaggaaaaagttctcaattttgaaccatatggactctccttttcttcatctggcttcactggacgacagtctcctgctggcatttctcttggttcagatgtatctgggaatagtgctgagacaggactgaaagagacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctgctgggaaaagcagatactgtctctcacaagttcagaaggaaatcaaaagtcaaagaagctaaaagtggcgaaacaaccagtactcataatatgacctgttcttcctttagttctttgtcaaatgtggcatatgaagatgattattattcgaatactttgcacgatacaggagacaaggaattaaagaaattttctctcacttcagaacttttggattctgagtcactcacagaactgcccttggttgagaaattctcatattgtagtctgtctacaccttcattgtttgctaataacaacatggaaatttttcaccctcctcaatctactgcagcctcagttgccaaggaaagctctttagcttcatcttttttggaagaaactactgaatacatacactcaaatgctatggaagtctgtaataatgaaactatatcagtgtcttcttataaaatttggaaagatgattgtttattgatggtctggtcagtcactaataagagtggtttggaattgaaaagtgctgacttagaaatttttcctgcagaaaatttcaaggtgactgagcaacctggatgctgtttgcctgtaatggaagcagaaagcaccaaaagctttcaatatagtgtgcagatagaaaaaccttttacagaaggaaatcttactggttttattagttatcatatgatggatactcattctgctcagctggaattttctgtaaacttatcactattagatttcattagaccattaaaaatctcaagtgacgactttgggaaactctggttatccttcgcaaatgatgtgaaacaaaatgtaaaaatgtcagaatctcaagctgcacttccttctgcactaaagactctgcaacagaaactaagactccatattattgagattataggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttatgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaagggagacatgaaattgataatctcaaacttaattcatatttggctttggaatgtagtgtatggtttttggtagggaagtcaatattttcgattatgttttgcttagatcagtgttgaactaagttggcatagcacacactaacagttgtaggagatccatgagcatgctggatattgaggggatccaatctgtgatctattttttattatagataactgttacacataatttcagatcgtttggctgtaaaatttgtctgttttccacttggagttattttaaaattcaaagtaaatcactctattcttattttgaaaactcaga

SEQ ID NO: 8437 - DNA, 1321 bp, Homo sapiens
ggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccccgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggtaagttggaaattttagcaagtactgagtagttaccattagaaaaatacaattatggaattaaaaagaaacagatattttggtaaaatgctagttaacattttataattttattattgacctttgaattagtagttttgcaagtgttgagagcatgagttgtaggcacattacagaattagtttttttttttttaatgcctaaaattttttgatgttactaaacaggtgtggaaaaatggtatcagtggaaggtgtcttaagtttgcagatttgtgttttttcaagcagtaattctcttttatataacttcatgggatgcataacattttatagaaatgaggaaaaccagcgggggttgtgcaagctatagattgtagtattgactccatgtattaattctgtatcatatgaggaaagagggttgaatgttatggtaaaacacttttctaaatggcgatggtggatttatactaattcatccttagtgtattgcctgaaaccatttgtgttcaaatatacatatttgtaacagatttcatggcacctactataacaaaataaaatatgctattgaactc

SEQ ID NO: 8438 - DNA, 872 bp, Homo sapiens
ggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggtatgtatgtgttttaagactttgatgctttcatgttgtccttgaagttccatctattatacaaaatgaatgatggcatgtatatagtatgtttttagaatactgtattataatttctaaaactttaaaagatcacacttcagaaagtcaaagccatttataggaaatcagttttcctgatgcatagcattttggagttaaagagaagactaaaaatttcttgctcttgtgatggcggttagatgactatatatgtcagaactcattgaaccatacacttaaatattttttgtatataaattatatgtctataaagctgacttttttgtatataaattatatgtctataaagagctcttttttttgttgttgttgagacagagtctctctgtgttgcccaggcagaggttgcagtgagctgagattgtgccactgcactccagcctgggcagcagagccagagcatgtctcaaaagaaaaaaaaaaa

SEQ ID NO: 8439 - DNA, 422 bp, Homo sapiens
cacaaatataaaaataaaacaatacaaaaacatatatacccccaaaatgttttgttttgaatttttttaactagtttttcttttttcactatgaaagtaaatacatttatggttttttgctttgtttgaaaaaaaaccctcagaatataaaatgaaaaacagcccccaaaacatctctagctcaaccccgaaaaacaatttctagagattcccttctagaaatttcctacatacaccattagcatatctttctacccctaaaagagatctaattatcatttttgctctccatcctttgtttattgattctcagtcttttctcccctcctaagtacccatcactctccctcaactggatctgcaatgccagggaactcagctactcttctgaaggaacttcactgattttaccctttcttttc

SEQ ID NO: 8440 - DNA, 313 bp, Homo sapiens
attacctcgagtgtaaatgaattaaagtttctactaaaaagatatagatcagctggatgcttaaaaacacatgatcctacaagaaactcatcccacttgtaaagaaacacagagactgaaagaaaagcaatggaaaaacagatggcaagcaaattgaaatgaaaagtgagcaggaatacctatacctacatgagttaaaacagattttatatctaaaacagtaaaaagaaacaaagaagatcattatataatgataaagagatcaattcactaagagaatataacagttacaaacacatccacccaacattgg

SEQ ID NO: 8441 - DNA, 253 bp, Homo sapiens
gcatccgaagatgggtgacctaaccaatatccccacccctcttcctacagggtgggtttctccttgttttagcagcctgccttgcccctctgaccctaccatttgtcattccctgtggccatggtctgccttcttttccctgctccaggtttataggttttttagccaatacaaactgtcacatgaagttgtctctaagtagctgtctttatatcatgtggggccaccaccttgattaaacctatagtcgacg

SEQ ID NO: 8442 - DNA, 297 bp, Homo sapiens
ttttttttttgtatttctgtggggtcagtggtaatggccactttgtcatttccggttgtgttttttcatatattctcttttttatcttgattagtctatctagcagtctaccaatcttattcattccttcaaagagctaaattttagttttgttgatcttctgtatggttttttcacatctcaatttcactcattttaaaacccagtttggttatttcttttggtatggtagcattgggattggtttatgcttgtttttcttttttcttttttttttgtttctttgtttcttttttc

SEQ ID NO: 8443 - DNA, 402 bp, Homo sapiens
cagaagctggaggaagaggggatggagggtgactgctaatgggcacggggtttctttgcggggcgataaaaatattctggattgttagtggagatggttgtacaacactgtgaatatagtaaaaaccactgaattatacactttaaaagggcgaactttatagtgtgtaaattatatctttaaaaaagtcatgttttggattcaaacaggctgaaatcaaactctgtctaaaccatttaccagctgtgtggctatgggcaggttatttgaactctaagtatatccttcatttctaaaatagaaacaatagcagtgtgtaccttaagaagttattaggagatttacactactcaggtaatgggtgcactaaagtcttcaccatcatacaattcagccatgtaa

SEQ ID NO: 8444 - DNA, 411 bp, Homo sapiens
aattttagaacattataacatttttccccatataagcaatgtcacgtaaatgtgtaagtcatccctgggttgctacagatgcttatttacctgtggtatttctgaagtgcctaccattattaactaaaacattttgagcaagtagttctataagttcagcgttccagcttagaatgccaagaaatgtaactattccctctccttttggggttagggtggcaaggattccctgggttctaaacctctctgattgttctcttgctattgatagggtttgtgggataaacagtgggaacaggatttgaagaaccaagatgggaattttgggtgtcatatggggattttttaggaaagcttttttcagatgggagtctcactctgtcacccgggctagagtgcagtggcatgatc

SEQ ID NO: 8445 - DNA, 354 bp, Homo sapiens
gtcagtcatattaaatcacttgtcctattcagagaagtaatactgaaattaataagtttaagataataagtatagactgggtgcagtggctcacacctgtaatccccagcactttgggaggccgaggtaggcagaccacttgaggccaggagttcgagaccagcctggacaacatgaaacccaatctctactaaaaatacaaaaattagctgggcatggtggcacatgcctgtaatccaagctactctagaggctgaagcatgagaatcacttaaacctgggaggcaaaagttgcagtgagccgagatcacaccactgaactccagcctgggtgacagggtgagaccctatctc

SEQ ID NO: 8446 - DNA, 460 bp, Homo sapiens
tgagactgagtctcgctctgtcaccaatgctggaatgcagtggtgcaaactcagctcactgcagcctccgcctcccgggttcaagcgagttcctgcctcagctacctaagtagctaggactacaggtgctggccatcacgctcggctaacttttgtattttttagtagagacagggttttgccatgttggccaggctggtcttgaatttctgacctcaggtgatctgcctgccttggcctcccaaagggctgggattacaggcgtgaaccaccatgcccggcaagcttcaattattaattgaataactttgtcattgtcctgtcctgttctacacgaagggagggcctcactgcacactggaaacagtgcccactgtgcaagggcaggcaggtgtgcacgcacacacacatacgtgtctacaaagccacacatgcacgcctttaacgggagatcctgctg

SEQ ID NO: 8447 - DNA, 846 bp, Homo sapiens
gcacctggccgaaagccaaaacattttaaacaaaatgtgctctatacttcaatcttgacaaatccataacatcattaaaaacatttgttttgttttgttttgttttgagacaggagtttcactcgttgcccaggctggagtgcaacggcgcgatctcagctcactgcaacctccgcctccccagttcaagcgattctcctgcctcagcctcctgagtcactggaattacgggcgcctgacaccacgcccagctaattttttgtatttttagtagacatggggtttcactatgttggccaggctggtctcgaactcctgacctcatgatcctcctgcctcagcctcccaaagcactgggattacaggtgtgagccactgtgcctggtccattaaaaacatttgtaaagctatggtgttgataaagtattatgaaagactgcaaaaaaagatggctaatttttagttattattgcacatgtttagaggagctaatgacattttctatgattaataaaagacattatttatgtttttatttatgtattccacaacatttattttattttctccatttcaggaaaaccactatgttgttacaataaagattttcatgtaatttgtgttcaattgatagtaataatgtaacaagttaaaaatgaaggtaattgtgtttaaaatttgagcatattttcatcaaaatgtaagttaaagtgattgtaaattttaagatcataattactttgtatatcttcaagaaaattattgttttaaaatatttatgcctattaaaattagaaggcaaaataaaaatatatgaataccaacattttaaataaaaatcattta

SEQ ID NO: 8448 - DNA, 712 bp, Homo sapiens
gcacctggccgaaagccaaaacattttaaacaaaatgtgctctatacttcaatcttgacaaatccataacatcattaaaaacatttgttttgttttgttttgttttgagacaggagtttcactcgttgcccaggctggagtgcaacggcgcgatctcagctcactgcaacctccgcctccccagttcaagcgattctcctgcctcagcctcccaaagcactgggattacaggtgtgagccactgtgcctggtccattaaaaacatttgtaaagctatggtgttgataaagtattatgaaagactgcaaaaaaagatggctaatttttagttattattgcacatgtttagaggagctaatgacattttctatgattaataaaagacattatttatgtttttatttatgtattccacaacatttattttattttctccatttcaggaaaaccactatgttgttacaataaagattttcatgtaatttgtgttcaattgatagtaataatgtaacaagttaaaaatgaaggtaattgtgtttaaaatttgagcatattttcatcaaaatgtaagttaaagtgattgtaaattttaagatcataattactttgtatatcttcaagaaaattattgttttaaaatatttatgcctattaaaattagaaggcaaaataaaaatatatgaataccaacattttaaataaaaatcattta

SEQ ID NO: 8449 - DNA, 427 bp, Homo sapiens
gatattagccataaactgaatgtcagccagctcataacacacattgttcctgaatagttgaactcttactgcctcactctgcctctgtggcagctttgagatcttcagtgctcatttccctcatctggtctatttcagcaatagaattggttctgatcccttctcccttaatccttatttaaatactccactcttcaagacacttgtaagttcaaaaattttcccacctatttccattctctggatacctgaagagttacttcaccccagaggttttaagtgtgatacactctttcatggctctgtgccgactgtggaccctctcctgctgatgttgtttgttttttttgtttgtttgtttgttttttgttttttgtttgagatggagtctcactctgtcatgaggctggagtgcagtggcatgatc

SEQ ID NO: 8450 - DNA, 305 bp, Homo sapiens
aaaaaaaaaaaaagttagggggtaaagggtttcaagatgaggatgttgaagaaattcaagagcaaatagatactacaccagagtaattaaattaataggagatgacttgatggaaatgggtgtttccatgttgttcaaggggcagctatgataacaatatcaaacaaactataggttgagtaccctttatccaaaatgctttggaccagaaatttttcagattctggaatatttgcattatacttaccgtttgagcataccaaatccaaaattctgaaatgcaaaatgctctagtgagcatttcc

SEQ ID NO: 8451 - DNA, 485 bp, Homo sapiens
taatctagggtctccaaaaggctgtagacttttccccccaagatccctgcatttttttgtgacaggctgggccttagatgttccaggctcttcaccggactgtcttcttgggaggtcaggccaacaggggtctttaactaagatgaaggatgggttgatggaactggtcactcacaggtcaggtctgaagcccaattcacactcaactaatcacaagtggctgacgttgaggagcagagaggggtgcagctggcacttcctgatctgaggatggctcttagaaccagggaactatccagtctcttaggatgattcagtggacctgagagctttgataatacgtttcaatttggcctatcactgacatttgggtgattctgcaagttctgagccagaagaaaaataaagaatggttgtcaaagttggaatttaaaatggtgggccatttcaacttggcatacttgtccataatgcatatagtaaaa

SEQ ID NO: 8452 - DNA, 404 bp, Homo sapiens
gcatcttgtcttttctcacttcataaagatttccatttaggacctccccgtggcagagcagctgtatctcttcaccctcagtgaccctaccctgcaggaagattccttccctgcaagtggctttatgcctcatgggcttctctgactacatctgggaaatctgtggaggtccttgacctgcaaaagggcaaagcttccccaaaaaacctttttgccctccttgagtgcagaccttctttgctgatggctgggcccgatgggcagtccaagattttcatctggatgatgggagaaataaacagaatgttttcagttgtcttgctccagagaagagatacagttcttgtaatatgggaggattttcatacctacattgaatattaaaatattacataagccatatg

SEQ ID NO: 8453 - DNA, 414 bp, Homo sapiens
atcccttgcctgcctcggagggctgttgcagtcaccaagtgactggacctgaaggtaagctgcccaaggggctcaattgtgagtgttccctcctcccacccaaggtcagccttgtcaataataaacacagtgactctctgagcacctgccaagggccaggcccgccacatacggtgttattctcacaatctacaagaaaagtactattagcgccatattcccaaggaagaaagtgagtgcccagagaaaaaactaaaatttcttggaggtgaaaaatagagaccaggctcagtggctcacacctgtactctgaaagcactttggaaggctgaggcggaaggatcattgagcctgggaggtcgaggttgcagtaagccaaaattgccgcactgcattccagcctgggtggcagag

SEQ ID NO: 8454 - DNA, 1937 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8455 - DNA, 2504 bp, Homo sapiens
atggcggcctgtcttagcagaggtggctgtcctcagggcccgtccgtcactgtcatgcagtcagagagcatatctcgggcctcaaagtgtgagctccctacgtgtcctgacctgtctgtgagacgggaaccccgcttaccttgtcatgtagatgtgatggccctgggtgtccagtaacatccccagctcagcctggcacgtggagctgggccttgcagggcaggggcccctcaccccacccctgggctcagtgcttttcctaccatggggtgccttgagggaggcctggcatgaatgggaaccgatgaagttcctcagtgtgtgacccatggcctcttccttctcctcactgacttgtgctctgcaaaaatccaggagaagtttatgtagctcctcatcaagtacctaacacacttttggccctgggaatagcctgggccccactcaaagagcttcctctcctggcacagactgaacagtagtgatgcctcttgagaatcgatgcgtcccgggctggagctaggacgtcagccgtgtttcagggtgtgaacagggaccctggggctgtgaggccaccccccactgccctgttccgagcagccactgggcctcagtggtttctgcttctcctccgcatgaagggcacgggagagtcatggtggactatgggactaaccctgggactaagtctgcagcagagggctggacaggtttttctggccttcatgaattcaaggaagcatgtgatttggattgaaggagcactattggtacaatcgtgaggatggtctcaggccgcctcttgaagattttggaccagatgaactggttccagacttgcaggcccagattcttacccccgggggtaaagttcctggtggggcctgcagaccttgtactaagtggcctctggttccctttcaacagtagcctgtggcccctcgagggttgctcagtccctagatggcacagccagggacagtggtgctgaaggcatgggtgataagctgtagtcccactggggaaagtccacattcagacaggaagtggaagcaccaaggcctgctggaatgaagttcccaggcaagcagtgagggccacaggctgcagtgcttcaggacggatgtttggagaacatgtgccagatcatgccaggtggttggtggggccaagccagggacacctcttgctgctactgaaggaccccctgagccccagagtgctcagcacccccaggccccacagaggaggtgcagagtagggttggtactcagtttgcccagctccccaccagaggctctgccacctccactctgtggtggcctgtgggccacgtcatcagggccaccttctcagtcaggtctcctggggccgataggtccaactgaacaggacttccaccaaggggctggggggtggaccacgccagggcctacttcttcatgagcacatgacggagcgtgtgtgtgatcctcagtcattcactgagcgcccccttgtctgggctctggggcgcagcaggaagcaaagtgaggggctgaagttccgctcagggataggtgaagtgcctctggttgctggaacctgagacctggctttgtgaccgtcagcacagcccacgtatatacacccttgccttttctccaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8456 - DNA, 265 bp, Homo sapiens
atgtcctgtccatctccatccccctaaaattaatccacaagtcagtaaaggagatgcaagagttagcagcaggaggtccattttctaagacagcaaagctgcaccgagtccacctccgttcatgctgcttgcgtacgggtgtcatcgtgctgcctcaggattctctagcgggcctagtgtctgctctctacagaacagggaggggcagcttccatttaagaggaaactctcactcagcgaatcactgctaatacataattcacac

SEQ ID NO: 8457 - DNA, 2149 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtgaaaaaaaaaaaaaaagaaagaatagaacaaaaaagtacaaaaaagagaaggcaaggagagggcggccagatagaagtaacagaccgggggggggacgaagcggtggagggtatccgcgggcggggagcgtgtcacggacgagggaccgcgagactaagtgggggcgtgggggatcggcgaagcgggaagggcgcggcctggtacgacggacgc

SEQ ID NO: 8458 - DNA, 2002 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggtacgagggcgggtaccagaggagctgcgggagcgagagtgcgtgtggcggccgccgggtcctgggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8459 - DNA, 1382 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgcccacatgtctgcactgagaaactgcatttcagtagcatttgtcatccagccggaagttaaagcacacttactttattcacctatttttataataaacgttcttgctgctgtga

SEQ ID NO: 8460 - DNA, 1531 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgacccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8461 - DNA, 1569 bp, Homo sapiens
ggataaggacagtgtgaaaggtggtgtggcctgaagacctcccatccgggctctggcctgggccaggtggggtgggcctgggcagggagaaggtggtcccttgtccctgctttgcttctctaccaaatgaatgatcactacccgctgcactgggggacgcagtgataatctgtggcctcagcctctgggtctagctttctcccctcttgctgtatgtgacagagtgtcttctctctgtcccttcctcatgcagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8462 - DNA, 1110 bp, Homo sapiens
cctagaggatccccgttattttccttctttattggagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggccgagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccctcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8463 - DNA, 1170 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcagattctcgcttacaaggatgacttcatgtcagaaagggccgatcgggaacgggctcaaagtaggattcaagaactggaggaaaaggtcgcctctttgctgcaccaggtgtcctggagacaggtcgcctctttgctgcaccaggtgtcctggagacaggattctcgagagccagacgccggccggattcacgctggcagttttgctcccagc

SEQ ID NO: 8464 - DNA, 1292 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcggccgatcgggaacgggctcaaagtaggattcaagaactggaggaaaaggtcgcctctttgctgcaccaggtgtcctggagacaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgcccacatgtctgcactgagaaactgcatttcagtagcatttgtcatccagccggaagttaaagcacacttactttattcacctatttttataataaacgttcttgctgctgtga

SEQ ID NO: 8465 - DNA, 1007 bp, Homo sapiens
ggcacgaggggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcaggaacatctggcagagggaggtcccagtctgtgtcccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttactttattcacctatttttataataaacgttcttgctgctgtga

SEQ ID NO: 8466 - DNA, 318 bp, Homo sapiens
gtgggtgaacgagcgggccccgggtcctgaggggttgagggggtactgggtcctggggttgagttggcctcgggtcctgaggggttgggggagcaccaggtcctgggagttgagggggtgccgggtcctgggggtgagggggccccggctcctgaggggttgggggagcatcaggtcctgggggttgagggggtgccgggtcctggggttgaggggacactaggtcctgggggtaaggggccgtcgggtcctgggggtgatagggcaacagcttctggggggtgaggggaccctgggtcctaggggagagagggggac

SEQ ID NO: 8467 - DNA, 476 bp, Homo sapiens
ggggacgcagtgataatctgtggcctcagcctctgggtctagctttctcccctcttgctgtatgtgacagagtgtcttctctctgtcccttcctcatgcagtcggaacacacagatgggcacacctctgtccagagtgttattgagaagttgcaggaagaaaatcgactgttaaaacagaaggtgactcacgtgagtgtctttcacatttcgtttgagaagaacacatggcttacaaactgtaagtgagggttctttccttggctgatgcccagagtcgccccccgccctctggccactaggacttgatacacacagtccctagagactggacttttttgcttaaaacgacgtacgggacatgtcctgtccatctccatccccctaaaattaatccacaagtcagtaaaggagatgcaagagttagcagcaggaggtccattttctaagacagcaaagctgcaccgagtccacctc

SEQ ID NO: 8468 - DNA, 294 bp, Homo sapiens
tgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcaggtgtctgtccctcgggctccggacggcactgaccagatgtctgctgg

SEQ ID NO: 8469 - DNA, 362 bp, Homo sapiens
ctcttatggtttttttaaaaaagcttcataaaacaggaaagaactacatatatcattaaactttcatgattgatgcccaccacatccgtgggggctgtggagctgttttggccacagcctgggcactgctgtccacctggaggaagttcactagaatcagcaagaaaataagccatagcctgtggagcatttagcctttcagattcgcctcctatattaagtggtacatttatagccaagtgaactaaaaagaagtgaaatgactgtgcagaagaaccaatctcagcctctgtgaagattgtgaggccttcacatgaaatctgtgcatatgcactggctttccctccacagttcctctgcag

SEQ ID NO: 8470 - DNA, 380 bp, Homo sapiens
aaagtgctgggattacagatgtgagccaccacgcccagccatattaagctatttacatcagggacttgagcatcctcggatttggtatctacaggaggttctggaatcaatcccccaggaataccaaagaataaatatagagtgagagtgtgcgtgtatgtgtgcatgtgtgtgtgtgtgtgtgtgtgtgtgtgtgtgtataaccacatatataaacatacataaacatatgaacatacacacatatatacatatatacacacatatacacccacacacatacatatatttttttcttgaattggtcttcatacaaaaatggctatgtcccctctcctaaacatttctcatcatgttccacaggaaaaaagaatcttcca

SEQ ID NO: 8471 - DNA, 1730 bp, Homo sapiens
gagcacatttacctaaaaaaaattttttaatttttaaattttttttaaggaagtagaaatattaaatttccaagacaattttctagcatctactacttggtcattttaatttacacttttcaacaacagatttcaatacagttatcatttgcaaattcatacatactttattcatcatctaccacatgatcaaagatgttttatgtgaacgttccctcctacttcataagctctctgccctcactccaaaaagaataaaatgcctcaaggtttattgaaggacatggttctgatgcctgacctaacaaggattggaatggctgggtggcagggtctcactctgttgcaggtgctggagtgcaagtggcatgattttggctaactgcaaccttgacctcccaggctcaaggaattctcccacttcaccctccggagtaactgggactacaggcacagactgaggaattgcgcttggcctaataagaatgattcccctgggggaaagaaacagaagagcatttgacaactacatgggctggcataatggattggaatttaaaggtgctacaaatgtgccaccagtttatcacatgggacattttctcaccgagtgaagcaggaagctggtgggcctaggccaggaaggcagagtgaaatttcatgacgcttagaagacaaagagccttgctaaaattaagtgaatggtcctgcaacaaatacacaacaggtctcccttcttaagaaatccaccagattgtgaaactgcatggggagagaagcacgaaaggattaagtttaaaactccaaagcacagaaaaatgctgaggagacagggactcacgaggctttcaatcagaagcctgaaatggtcacacttgagcatgttgctggctggaaaggcagagtaaaatgtcttgtgatttcatggtgttcaaatctctgaaggacagatgactctccattggtatttcaggctttccctacagtaggcaagtactttggacctaccagtctttcaacaaaaagctcagaagggtcacctctaaggaacaggtataaatcagaggtgaactaagtttcattaaaactatacctcagctccaacctagctcaattccagattggatgtggtgattttcaccttaccacatctagttaacaaggaaaagtttgcaccatctctgggggaaaatagtatcacctgtactttctactatacacaatatatgcatatagttaaaattataacgcatataggaggaagaaaaaggatatcaataatcaagataaaaaacaaacagagccaaatccacccatgatctatatggtggaattagcagacaaatattttaatttaatttaatttttttttttttagagatggggttttgccatgttggccaagctggtctcaaactcctggccccaagtgaccagcctgccttggcctcccaaagtgttgggatttacaggagtgagccaccattcctggccccaaaaaattaaaaatcactattacaaattttaaaaaaataattgaagaagagatataaaagtaagtgaaaaagtagagtgaaaatgtctagtcaattaaaatttatttaaaagaatcaaatgaacaatccagaaatgaaataataaactaatcaaatgggtttaaggacatattagaaagactagtgaacacaaaaacaggtccaataaaaatattcaaactgaacatagaaaga

SEQ ID NO: 8472 - DNA, 499 bp, Homo sapiens
gagcacatttacctaaaaaaaattttttaatttttaaattttttttaaggaagtagaaatattaaatttccaagacaattttctagcatctactacttggtcattttaatttacacttttcaacaacagatttcaatacagttatcatttgcaaattcatacatactttattcatcatctaccacatgatcaaagatgttttatgtgaacgttccctcctacttcataagctctctgccctcactccaaaaagaataaaatgcctcaaggtttattgaaggacatggttctgatgcctgacctaacaaggattggaatggctgggtggcaggcaagtggttttcaataatttattttccatgatagtataaaagaatatagaaagaaaagattaatccttttaattttgcagtaaaatttacattccctaagtgcaaaaagacctcatcctctgacacctttaaccacaaattactaaataaatttatttttgatggca

SEQ ID NO: 8473 - DNA, 414 bp, Homo sapiens
catgccgaaagcgctcagtgctcctgaagctgggtggcaggtgttttcacacacaaaggccttccttgctcgggccatgggataagcctttgagtggagacctagcaaggagctttgaagtctgcgttgggggtggaaggtggcaatcccattagacagctctccctggcgtgaatttatgaagccccatgcagactgtgacttttaaaataatcatttagttggttctagcacatatcgcaggtttcattacaggctgccccttaacgagcattgtaacctggaggaaagaatccaaattctttagtcaccacctaactccacattcattaccttgttgcccagggtggagtccaaaagcagcaactatgtttatttctccatagaaaataaatgttcaccaaggcaaatctg

SEQ ID NO: 8474 - DNA, 491 bp, Homo sapiens
gccaggctggtctcgaactcctgagctcaggcgatctgcctgcctcagcctcccaaagtgccgggtttataggcgtgagccatcccgcctggccccatctcactcagtttttagttcatctgtgactaattccaggtgaagttggctggtgggtcttttgttatttctcttaagttctaacctcatttttaatattctaaattttctatttctcttgtaagaatttgcccttttgggccaggcatgatggttcacacctgtaatctcagcactttgggaggccaaggcaggtggatcacctgaggtcagtagttcaagaccagcctggccaacatggcgaaaccctgtctctactaaaaatacaaaaaattacccgggtgtggtggcgggcacctgtaatctcagctacttgggagactgaggcaggagaatcgcttgaacctggaaggaggaggttgccgtgagccgagatcatgccattccaacctggg

SEQ ID NO: 8475 - DNA, 349 bp, Homo sapiens
tgacagctgcgcattaggcatagtgggaaaactctggaaaagatttacctacgaagacaaatttgttggaatgtttatgtggcctaaattcttgagtaaagtttaaaaaaaattggtgcagagtttggagttgaatttatgatagggtcatagaaaaccaagcaaacaaaaaacacaataattaattttatggagaattaaaaggttactcatgacataccttaaggtaataaaagccatctatgggctgggcacagtggctcatgcctataatcccaggactttgggaagccaaggtaggtggatcacttgaggctaggagttcgagactagcctggccaacatggca

SEQ ID NO: 8476 - DNA, 266 bp, Homo sapiens
tattgctaaaaaacgtaaacttttttaggtctgagcttgaaaaaacattcaataatgaaaaatgctggaaggtcaaatactgaatgtcattttttttcactgcaattggagagaaaacaatcatgaacaatttctccctttattcatgcccatatgttattaattccttgttatgtaccacatgtttaaggcacttctgtcagctatgaatatttctgatattattatcatgttgatgtcaatataatgatttgccttttagcagt

SEQ ID NO: 8477 - DNA, 363 bp, Homo sapiens
ttcctcatctgtaaaatgaagatcatacaactcgtttcatcaggttgtactgaggctggaaaagatagtctaactactgacgcatcgtgtgctcagcctagggtggctgctaccgcgggtgcctgcggactcctaggacgggcaccagcccgggacccctgacaaggtgttgattagggtgtggctaagccccaggcgggagaaagcgttggcatttataaggccagggtctggcgcggtggcctcattccgtcttgaagtagaccctggagaggtcttccaggcttgggctcagcacgcgagcacagggagcgggggtgccggcggcggaggcgcgtacggcccgagcagcccccagccccc

SEQ ID NO: 8478 - DNA, 277 bp, Homo sapiens
gcatgtctagtgtttgcaaatggaaaatggctgaggaaaaacagagtgaaagtttatataaaatatttataccttaaagatcttttatcttgtgtcattcaagagagaagtgaaaaatgtattgggagtacattatcaagagtacattataaatttaaatctcagattgaataatatcagctgctaatgtgtggagctttggaaatgagtcacttttgaatctcaagaacttaactgtaccaggtcagttacacttaagaaggaagtgccttttgaa

SEQ ID NO: 8479 - DNA, 555 bp, Homo sapiens
tgtgcttctccctgcaggatgctggcacgtgtgtcctggtcctcaacaaccttctgtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacaggtgggtcgtggggcaagggtgggtcatggggtgagggtgggtcgcgccagcgcacagacaccacatgtgggttaggtggagttgtggccttcacagtgcagtgcctgccccagaacttcctggtaagtgtgaattgtgctggacccctggcctctaggcacgatgccaggcgcacagagcacaccatgggcgcacggcatcagattgctttccggcactgtgtcccgccgcctacaacgcgaacacttgcccttgcgttca

SEQ ID NO: 8480 - DNA, 5859 bp, Homo sapiens
tgtgcttctccctgcaggatgctggcacgtgtgtcctggtcctcaacaaccttctgtgagcctagggacccatttctcctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtaccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatgg

SEQ ID NO: 8481 - DNA, 6699 bp, Homo sapiens
atgcctcccggtaaccaggtgtcgtcagcaggagctttctggatctgtgtcccctgtgtcacttcctttctttgtttcttcacacacttcctgagatgtgaaccctgcctgggacaatcgcttttgttcctggagacagtgtacagagcttggaattctctgaggggttcctgagatggcgccattcaagccagggggttgaatagcttgactcttcatttcagcagcacgattgacccctcagtggatcagcagcgattcattccacacgtatttagggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtaccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaggtgctctccaaggtgcagcagg

SEQ ID NO: 8482 - DNA, 2527 bp, Homo sapiens
ggtacccgtacgaatgtgcgggcccgtacggatgtgcgggccagtacggatgtgcgggccagtacggatgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtaccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 8483 - DNA, 6015 bp, Homo sapiens
atgcctcccggtaaccaggtgtcgtcagcaggagctttctggatctgtgtcccctgtgtcacttcctttctttgtttcttcacacacttcctgagatgtgaaccctgcctgggacaatcgcttttgttcctggagacagtgtacagagcttggaattctctgaggggttcctgagatggcgccattcaagccagggggttgaatagcttgactcttcatttcagcagcacgattgacccctcagtggatcagcagcgattcattccacacgtatttagggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagaaggcccccgatgcgctcagccatacccccagcgtcaggcgtctgtccctgctcgccctgcccgcccccagccccaccacccctggcccccaccctccagccaggaaggcaagccctggcctggagagggcccctggcctccctgagctggacattggagaagtcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtaccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatgg

SEQ ID NO: 8484 - DNA, 6951 bp, Homo sapiens
  misc_feature (2898)..(2898): n is a, c, g, or t
atgcctcccggtaaccaggtgtcgtcagcaggagctttctggatctgtgtcccctgtgtcacttcctttctttgtttcttcacacacttcctgagatgtgaaccctgcctgggacaatcgcttttgttcctggagacagtgtacagagcttggaattctctgaggggttcctgagatggcgccattcaagccagggggttgaatagcttgactcttcatttcagcagcacgattgacccctcagtggatcagcagcgattcattccacacgtatttagggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagaggacgaggttagccagccgctggctgcaccgccctccaagatccacgtgctgctactggtgctgcacggaggcaccatcctggacacaggcgccggggaccccagctccaagaagggcgatgctaacaccatcgccaacgtgttcgacaccgtcatgcgcgtgcactaccccagcgccctgggccgccttgccatccgcctggtgccctgcccgcccgtctgctctgacgcctttgccctggtctccaacctcagcccctacagccatgacgaaggctgtctgtccagcagtcaggaccacattcccctggctgccctccccctgctggccacctcctccccccagtaccaggaggcagttgccacagtgattcagcgagccaaccttgcctatggggacttcatcaagtcccaggagggcatgaccttcaatgggcaggtctgcctgattggggactgcgtcgggggcatcctggcatttgatgccctgtgctacagtaaccagccggtgtctgagagtcagagcagcagccgccggggcagcgtggtcagcatgcaggacaatgacctgctgtccccgggcatcctgatgaatgcagcacactgctgcggtggtggcggtggcggcggtggcggtggtggcagcagtggtggtggtggcagtagtggtggctccagcctggagagcagtcggcacctgagccgaagcaacgtcgacatcccccgcagcaacggcactgaggaccccaaaaggcaactgccccgcaagaggagcgactcatccacctacgagctggataccatccagcagcaccaggccttcctgtccagcctccatgccagcgtgctgaggactgagccctgctcacgccattccagcagctccaccatgctggatggcacaggtgccctgggcaggtttgactttgagatcaccgacctcttcctcttcgggtgcccgctggggctggtcctggccttgaggaagactgtcatcccagccctggatgttttccagctgcggccggcctgccagcaagtctacaacctcttccaccccgcggacccgtcagcttcacgcctggagccgctgctggaacggcgctttcacgccctgccgcctttcagcgtcccccgctaccaacgctacccgctgggggatggctgctccacgctgctggtcgagaccgtgcagagaaaccctgagctggtcctggagggcggccccctggcccctctcccccacggggacggcttcctggaaaccagtatgcctgttcccgcgcccacctggcaagacggnccccgcccgggctgtgccgagtcggatgtgctccagacccacaatgcagccttccaagagcatggcgccccctcctcgccgggcactgcccctgccagtcgtggcttccgccgagccagtgagatcagcatcgccagccaggtgtcaggcatggctgagagctacacggcatccagcatcgcccagatcgctgcaaagtggtggggccagaagcggatcgactacgccctgtactgccctgacgccctcacggccttccccacggtggctctgcctcacctcttccacgccagctactgggagtcaacagacgtggtctcctttctgctgagacaggtcatgaggcatgacaactccagcatcttggagctggatggcaaggaagtgtcggtgttcaccccctcaaagccaagggagaagtggcagcgcaagcggacccacgtgaagctgcggaacgtgacggccaaccaccggatcaatgatgcccttgccaatgaggacggcccccaggttctgacgggcaggttcatgtatgggcccctggacatggtcaccctgactggggagaaggtggatgtgcacatcatgacccagccgccctcaggcgagtggctctacctggatacgctggtgaccaacaacagtgggcgtgtctcctacaccatccctgagtcgcaccgcctgggcgtgggtgtctaccctatcaagatggtggtcaggggagaccacacgtttgccgacagctacatcaccgtgctgcccaagggcacagagttcgtggtcttcagcatcgacggttcctttgccgctagcgtgtccatcatgggcagcgaccccaaggtgcgggccggggccgtggacgtggtgcggcactggcaggacctgggctacctcatcatctacgtgacgggccggcccgacatgcagaagcagcgggtggtggcgtggctggcccagcacaacttcccccatggcgtggtgtccttctgtgacggcctggtgcatgacccgctgcggcacaaggccaacttcctgaagctgctcatctccgagctgcacctgcgcgtgcacgcggcctatggctccaccaaggacgtggcggtgtacagcgccattagcctgtcccccatgcagatctacatcgtgggccggcccaccaagaagctgcagcagcagtgccagttcatcacggatggctacgcggcccacctggcgcagctgaagtacagccaccgggcgcggcccgctcgcaacacggccacccgcatggcgctgcgcaagggcagcttcggcctgcccggccagggcgactttctgcgctcccggaaccacctgcttcgcaccatctcggcccagcccagcgggcccagccaccggcacgagcggacacagagccaggcggatggcgagcagcggggccagcgcagcatgagtgtggcggccggctgctggggccgcgccatgactggccgcctggagccgggggcagccgcgggccccaagtagggcaccgtgagtgcagcgcggggtctccatggtgctaggccagggtggccagccccgccaggaggcctggcctgggcacacgcactgacgtgggcctgggagattgtcccagggccttgtggaggacacgggccgcaccacacagtgctccctgccctgcctcacgtcctcgggcctgacgggtccggcttgtcatggaagctggcagggaccaccagccccaggatggcagagggaccagaacctcccactcagactggcccgggaggttctcccagacattttgccctgtgtggatctccaagtgtcctggtgccaggtgtgggcccaggcgcagcctgccacctccccatccactggccaccctcactcccaggtcccctcccatttggtagcagctccaacaggggtccagcctgcatcttgttaactcgagtttctcaactgttcaacctcactggttttgcactgatttttgagagcggagacccattaccacctcctatggctacagccccgttgacatgcatgaaactcagtacctgctgacccaggacctacaaccacactgaaggctccagtgcggcagagcctcgtgcaagcaggagagaaaggctgtatcttaatttctgcaccccggaccctgcccacctgtctgcctgccccgcctggagcccaggccagtgttgtttccagcctcaggccacgggctggacgggcctggccgcctcttccgctccctgccatcagtcaaggccgcccgcccacgtttctacgcctttctacttctcaatctgatttctatgaggtttttttaaacgagcaatccttggctgcttccttttcttaactctttcagtactgagagcagcccctccacactgaaaacacccagcactgtgacggagtccagcctggttctgggtaccgtgggccctgctcctgcccacttagcgaggcatgggctccttgcctcacctggccccggcaatcccactgaatttctactctggggtgggtggggcacacacttcggtttttttaatgccaattccgttttcatgccgaatctaagaagccacaacttgctttgtcagcttcagggcaggcagccatgacttcatttctcgcctgaacaaggaccatgctgtcctgcacgctgggtctgaccgtctgccctctctccccagcaccaagcgtgaccttggctgtggcgctcaacggccagctccggcggcccctctgctgctcctcggctttcccggaagtgggagagcctgcctggcctcggcctttgtccagcgaccaggctctgtccccgagaagctacggccgacctgggtctggtgttgggacgcatggaccgggctggggaggtgcacagagtgatgttaactttttcccgtgtgtagatatgtacagccaaagggtcgtgtaaatgttctgcaaaagtgggtctatacagagtgaaagctatttattttgtgcagagaaaaaagtctggagggatggaaccttcagggtttattcatatttaagatgtagctttttgttgtttcaggcattatgtataaagcaacgattattttatggaccaagttttcatgtaactgttgcagtgaaagtgcaatatctgacccccctgctcccagcaggaagttgcttggcccgacaatcacagcccctgtcaggggccctgtggccagtgcctcctcctctcttggccccaccttatcctgtcttgcctgctgcctgggagaccagccatccagagaagcacctggaagagtctcgggccctcctgcaataaaggccgggaggccctgtgggcagtgggctcagcctctccccaggggggcagctcccccacggctcctcactccccgcctgcctgcccagccgccagccatgccaaggacaacagcaatagtcccctggggctctcccagcggccctcagccatagatggcaaggtgggcagcctgcccccccatgggaagtctcttctgtatccaggtctgctttccacctcccttcagattccttttggcacattctcctcttgaggaagtaccagtctttctgaaactaagagagggagggcagcgtcctttaaaaataccaaaaatgtttacagagttgggtgctgagctgcagggctcaggcctgaccagtcataaccaaagggtgaggcaggccttgctgactgccaccccccaggcctgttagaatagaagccttagtcccactcccaccacacccccacgccccaccacctgccttctctttgatttctaaagagggattcagcagagaccccccacccctccctggctcggtctgagtcccactgcccaccccatcacagccttcacgtctcagcccctcccgtctggtctgtccgtgtgccgtctgtttctctgggccatgtgtgagcagtgtccccatctccccatccgtccctgctgtccccgcatcattgggcctgagtgtgctctgtatacaacgtcatgtctgttacaccaattaaagaagcgggaaggcttc

SEQ ID NO: 8485 - DNA, 1786 bp, Homo sapiens
atgcctcccggtaaccaggtgtcgtcagcaggagctttctggatctgtgtcccctgtgtcacttcctttctttgtttcttcacacacttcctgagatgtgaaccctgcctgggacaatcgcttttgttcctggagacagtgtacagagcttggaattctctgaggggttcctgagatggcgccattcaagccagggggttgaatagcttgactcttcatttcagcagcacgattgacccctcagtggatcagcagcgattcattccacacgtatttagggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcggcgtggagatcctggagaaccggccgtacacagatggcccaggcggctctgggcagtacacacacaaggtgtatcatgtgggcatgcacattcccagctggttccgctccatcctgcccaaggcagccctgcgggtggtggaggagtcttggaatgcctacccctacacccgaaccaggttcacctgtcctttcgtggagaaattctccatcgacattgaaaccttttataaaactgatgctggagaaaaccccgacgtgttcaacctctctcctgtggaaaagaaccagctgacaatcgacttcatcgacattgtcaaagaccctgtgccccacaacgagtataagacagaagaggaccccaagctgttccagtcaaccaagacccagcgggggcccctgtccgagaactggatcgaggagtacaagaagcaggtcttccccatcatgtgcgcatacaagctctgcaaggtggagttccgctactggggcatgcagtccaagatcgagaggttcatccacgacaccggactacggagggtgatggtgcgggctcaccggcaggcctggtgctggcaggacgagtggtatgggctgagcatggagaacatccgggagctggagaaggaggcacagctcatgctttcccgtaagatggcccagttcaatgaggatggtgaggaggccactgagctcgtcaagcacgaagccgtctcggaccagacctctggggagcccccggagcccagcagcagcaatggggagcccctagtggggcgcggcctcaagaaacagtggtccacatcctccaagtcgtctcggtcgtccaagcggggagcgagtccttcccgccacagcatctcagagtggaggatgcagagtattgccagggactcggatgagagctcagatgatgagttcttcgatgcgcacgaggacctgtccgacacagaggaaatgttccccaaggacatcaccaagtggagctccaatgacctcatggacaagatcgagagcccagagccggaagacacacaagatggtctgtaccgccagggtgcccctgagttcagggtggcctccagtgtggagcagctgaacatcatagagatcaaaaataagatcttcaccttgtgcccagcctgtctgctgtccctgaagataaaaagacgaaaagggaggaagcgacagtcgtctaggcagaagtgatgtggccgtggccgacaagatggccccgcgggaggcaggcggagctcagtgtgtccaataaaactgtcttggtagagcgccaaaaaaaaat

SEQ ID NO: 8486 - DNA, 485 bp, Homo sapiens
ttttttggtaataatttaacttaaataccacacagaagaaatgctacctagagctgactgttttccagtaagaagtcagcaatattaccacagttgggacacaaatatggaatcttactatgtttgcaaaggaccaaaaaggacctaagaaataaaaggaaaagtgcacactcaaaaaactgtcatcagatttgtagttagcttggaaatattctgtattttaaacttactattttctatgatccagaaacatcaattatttaacaaagaggtttatttagaggaggtaaaaaaaataggaggggaaaataccaagctgtaagagtaacaaaaagtttattttaaaatctgcaaagcatgactttgtcaacagctctagcatccagagtgtggtggattaaccctgtgtttacatacatccaaatctgttttctaaaagtatgtgttttaaatgccaaaaatgacctctatgagagaaatggaag

SEQ ID NO: 8487 - DNA, 189 bp, Homo sapiens
caactgccggcgcccgggcacacagccgacttagcgccgtccggaagcagagcacgtgcttcgtaaaaaatgaaatgactctctgcactctgaaatctttgaacatgtgcatctcctgaggcttggctgtggttttaacttctatatgccttaaatttcccaacaaacgaataaaattatgaatataaa

SEQ ID NO: 8488 - DNA, 711 bp, Homo sapiens
cactcctggactcaatctgcccacattggcttcccaaagtgctgggattatagacatgagctaccacacccagcctgtatggctgttgtgaataatatgctgttatgaacatgggcacactaaacaccattcaacttaaaaaaataatcaaagccttaagaactgaaccaaaatggcttaggtgaaaataaaataccaaactctgctctaagaaaaggaaagaacattcactgaattataccttcagcaataagcacttaatggaacttgtttcatttaaaatgcaccacaatcctgtaaattgataatcatcataccccaattttatagatgagcatggtattaggcggacctttttcaaaaggtcatacagctagtgacgaatatttccaaatttttcataacatttctttttttgagacggagtcttgctctgtggcccaggctggagtgcagtggtgcaatctcggctcactgcaagccttgcctcccaggttcacgccattctcctgtctcagcctccctagtagctgggactacaggcacccaccaccatgcccggataatgtttttgtattttcagtagagacggggcttcactgtgttagccaggatggtctcaatctcctgaccttgtgattctcccgccttggcctcccaaagtgctgggattacagacgtgagccactgtgccaggcctaacatttctgt

SEQ ID NO: 8489 - DNA, 414 bp, Homo sapiens
tgaagctgagggatcccatcccaggcccctcccagcccgttgtcttcaaggaagtgttgcgtaatcatcaggccacttcaatcttaccaaggggatgttcccctgcatgtaccacctcaatcttaccacagggatgttcacctggcacgtaccaccttaatcttaccacggggatgttcatctgcacctaccacttcaatcttaccacggggatgttcacctggcatgtaccacttcaatgttaccacggggatgttcacctggcatgtaccacttcaatctttccacagggatgttcacctgccatgtactacttcaatcttaccacggggatgatgttcacctggcatgtaccacttcaatcttaccgtgaggatgttcacctggcacgtaccactttggcttcaacgttga

SEQ ID NO: 8490 - DNA, 426 bp, Homo sapiens
ctgtgggtgtgtttcagccacctgtgatgcgtgttacaaaggcagtcacctaagatctcaccctggagctgggatccatggagctgggcaggttgaggtggttccaagttcagtacaggtggttcaaggtccctactctgagaaactgacatcaaatgaaagaagacaagtttagcgtgacagtcctttatcttcacacctcataattggcaagccacactgcttagccacattcaaagtcactggcaagtgattttattttattttcaagcgtgggacaacttaattttgtgaaatgtatattttttggtcatagcataagctaccactcctcagttctttttggctgttttacaaaccagtcaggaaatgtatggcaaaaacagcaaaaggaaagtcgattttaaaaatgtacgatgcatgttt

SEQ ID NO: 8491 - DNA, 359 bp, Homo sapiens
tactgatatgttatatcttatataatttagattacaaatcaataacattatgtctagtattcaacaaatttaaattactagtgaactccactgtgctaaacagtaaggccaccaaggtgagcaaaagcagtccctgctgtcaagaagcttagaggacagaggaatgttcaatcatagtatatatcatttgaatgtttatcttaataaagaaataaaactcagaagtagatggcctgcacattaatgtagttaatcttaaatctcaggtctgtgcaaagccccgtaagcagatcactcaactgaaagtcattgcagcatcacataccactgataatcacctgaactgcagacagagtgac

SEQ ID NO: 8492 - DNA, 1742 bp, Homo sapiens
gttaagaagcttcctgcagggggtgagaaattggactcaatgtcctcctgaaaagttcagctacagaaaggctgggtccctttggtacactcctcaccttgatccttagcaccgttgttaagtatactgattaatccaatcagtaagggcctgcggagtgagctgggctctggagtagatgtgattcaagacagaaaagcaggagggtacgccactcagatctcaaggcacttaggatccagttaaaggtactattaagacattatcagctgaagagtcagactgacctaagtttaaatctgggctgagccacaactagaccaggctttctcaacttcggcacccctgacttttttttgtgtgtgtgaaatggagtctcatctgtctcccaggctggagtgcagtggtgtgatctcggctcactgcaagctctgcctcccaggtttatgccattctcctgccttagcctcctgagtaactgggacaataggcgtccgccaccacgcctggctaattttttgtatttttagtagagatgggatttcaccgtgttaaccagggtggtctcgatatcctgacctcatgatccgcccgcctcggcctcccaaagtgttgggattacaggcgtgagcctctgtgccagcctttttgtattttttttttttggagacagggtctggttctattgcccaggctggagtgcagtgatgtgattagggctcactgcagccttgacctcctgggcataattgattctcctgagcttaaatgattctcccacctcagtcccccaagtataagagctgggactacaggcatccggccatcatacctgggctaatttttgttttgttttgttttgtagagactaggttttgccatgttgtccaggctggtctcgaactcatgagtttaagtgatcctcctatctcagccttcccaaagtgctggcattgtaggtgtgagctactgcacctggccaactttgccacaaatgaccagataattctttgttgtagggggtgttctgtgaatcacggatgttgggcagcatccctggcctctatctactagattccagtgccttccccgccaattgtgacaaccaaaaatgttgacagacattgccaaaagttcactgagcaaagaattgccaagattgtccgtccctggttggaagccactggactagcttgtatgacttttggcagacaaactaaactcttggtattagttccatcttttttaatgtatgacaacaatacctgctgtaagaatgaaatgaaatagcattaatcaagcttctaccagggagcctggcacaaagtagacagacacatctgagaaagaaccttcacacccaggttagtgggggaggcagggaagcttcaaaaagtgggaagcatttgacgtcgacttgaaggatgagaacatattttccaaaaggactagaagtattgtgattattattattcatcctccttcctctacccttgcaggcctcctctcacttgctggtcactccttcttctctcctgtaaaaatcaaccaaagagactcttctaaatcctcagctcctggaaacaggagatttggttctggcctcacatttaaccctccctgcgcctgctgctccaggagtgcatagactcgccccttgttctggagcaggccaagaatgacccgtttccccaccttgttaagtatgaattggaaatttgtacccatgcagtttccttgca

SEQ ID NO: 8493 - DNA, 333 bp, Homo sapiens
tgccaaatgcctcctgtggaacttccttaagtatctatgaatgtgtggcaagtagactaggatgggtaagctggaaagacccaggtttcctatccaaatggacgtggctttgagttgcaagagtcacaacccattagttggatggtcctgaacaagtcacacagcccccagtgatgctgtccctcatgtgtcaactggataaggtggcccagtacacaaggattcccaaggcaggctgtcattgtgtgtgccctctgcatcatggagatcctcagatgtctcttccccatctgccttggatcccttgttcatgttatggaagaagtgataact

SEQ ID NO: 8494 - DNA, 483 bp, Homo sapiens
acaatttcctaacatgggcctctgatattagggagattctggagttacatatcttgataatttaggagtaaatctcccttagcaacagttaattatgccttaatttattttgtgttgctaaagagcaaatgatgaacccattgagttgctgttgaagctttgatttgaatttagtaattcctgattgcctgtatcatgggactttctctagtattagacaatcttccagttcctcaaatgaggcatgttctattaggcagcaactggtgtgtttgagaccatttgtaagtattttaggtgatagacaataatacacatagtgccaatgataaagtcaatccagtcacaggaccacccagaaaatattggggactctaacaaaaggagcaacaaaatccaaaacaatcataacaaaaaatgaaagagggaacactgaatttgatgaattaaaaattatgagaagatttttgttggaaatattca

SEQ ID NO: 8495 - DNA, 303 bp, Homo sapiens
aatacattctgaagagagagaagtttggaagggagctgatatgtaaggatgctgacgtggctcttggggaggagaagaaaagactggaacgagaggttgaggccactttgtggaaagtcttaaaggtcaatcttgactgaagaattgggatttcttttcatccatgtctgcttgtgaactgcccactcttcagaatacccaattgctccatcatggatcactgggtctactgaactggaactgttctgatggattgacactgtagtgggaagagggagctctcgatgacgagatggcatggtt

SEQ ID NO: 8496 - DNA, 316 bp, Homo sapiens
cttggtcaattatcagttacacaggcagacctgtagtggccaggctgggcgtggtgccttacgccagcactttgggaggccaaggcaggtggatcacttgaggccaggagttagagaccagcctggccaacatggcgaaaccccgtctctactaaaaatacaaaaattagctcggtgtggtggtgcatgcctttaattccagctactagggaggctgaggcacgagaatcacttgaagccaggaggcagaggttgcagtgagctgagaagatcacactgttgtactccagcctgagcaacagagcaagactgtctt

SEQ ID NO: 8497 - DNA, 265 bp, Homo sapiens
ggtgtacaccttagagaagagacagacaagtatatgacgtaatcggataaatgtctcgacaatctattacagcagctcaacaaagggccacctaattgaacctggaagtatcaggaaggcttcctggaaaacgtgatagctaagtggagtttttaacaatagtagtaataataacaaccttgttattctaaatggttcatatttattttttaataaaaaatatttcatattttttatttatgaataaatatttaatatttgcagc

SEQ ID NO: 8498 - DNA, 403 bp, Homo sapiens
gcccctctgtcttccctcctgccctctgctctgctaacccgcatccccccactggcattggcctcggcctcttacacccctcagcctgtctctccatctttatcttttccttcttattagttttgttgtgttgtgttttttatttttcattaaaaaagtttttttgtggactgggtgtggtggctcacccctgtaatcccagcactttgtggggctgaggcaaatggatcacttgagcccaggagttcgagaccagtctggccaacatggtgaaacctcgtctctactaaaaatacaaaaaattagctgggcttggtggtgcatgcctgtgattccagctactcaggaggctgaggcggagaatggcttgaacctgggaggcagaggttgcggtgagccgagg

SEQ ID NO: 8499 - DNA, 492 bp, Homo sapiens
acacagatctacttcttcacacaggtttaggaaacagctcctccatgatcttactgaaagaaacaaaagggcgactagtgagataaaccaattcttttctgcagttattcttggggctgcaactggtgctcactctccctatcctccactgttcattctaagtttccctcagccttaactattaactcaggaagtctgggtggcttacctggttggtgagactcaaacttacatacatgatcttcatgtatcaagtccaaacatttgatagtttatactcttctcaatttgaggttgctgcacatgtctcttcacagttgcagttgaggcaaggaagacccattccaatctcctgctgtggggatcacagttgattgacactcccagctttcactcccctgaatccatcactgtgtttatgctgaagccatgttgccctcaatgtgctgtcagccagtgactaagcatgacaaggacactagtctcagaata

SEQ ID NO: 8500 - DNA, 138 bp, Homo sapiens
agagttcatgaatcacgctgtatctgctcagactctagtgacatcaaagtattttaaatgaacaaaatgtctttgggaattctgctttttggcaatctggacccttctgtctgcactgtgtgtctcttgtgcaacttg

SEQ ID NO: 8501 - DNA, 396 bp, Homo sapiens
ctctgcttcccaactctttctccatgaccaccagcgtttcttctgttgctttgaaatggagggcaccatcagctttcaactacttatcaaaaatgagcaacatcattgtgctctgaatcatttgctgtaatttctcaggcaaaacctggtttgagaaataaaacctaagaatagggactgggtgtgaggtctagagaacactccgacatcaaggccaggctggccaaccctgttctgcagagcaattagctacgtcttgcagctagatggctgtgttgtttttgtttacaggtgtccaatcttttagcttccctgggccacagtggaggaagaattgtcttcggccacgcataaactacactaacactaacaatagctgatgagcgttaaaaaaaa

SEQ ID NO: 8502 - DNA, 185 bp, Homo sapiens
tcaatgtgtgagattgctgacctttggatagggttattgtggttattttttgttatttattgtttttcttttaacagtctgaccactgtgtgtagggctgctgtggttttctggaggtctgctccagaccctggtgcccttggctttttcagtatctggaagtatcaccagttaaggctgtgaaa

SEQ ID NO: 8503 - DNA, 634 bp, Homo sapiens
tttctcttactaccactggtcatctgtcatttattaagaacctactgttggtttgactgtgtgtcaaatactgaaggcttttattattagctctttaatgtcatagtcttaattgaatactttgaggcattgtgaggacactagtttctccagggcttgggttgacattgtaaactaatgtggcctagggacctgcagcgtcagcattacttagggatcttgttaaagtttggggtggtgttcttcaattgccaacatgaatggaactaaaaaagtctggtctcccaacctcttgttagctatttgatggtggccaagcctcactgtgtgtctgttgccttacgtgtcaagaatggggatcctggagcaggtaatgggggttgaaggtggaagggttgggtagatgttggtcaagggatacaaaattaaatccattatccaacatggtgactatagttaataacaatgtattatatttttgaaaattgctatgagtggattttaagtgttctcaccacaaaaagtatgtgaggtaatgcatatgttaattccctggatttaaccatttcacaaggcacacatatttcaaaataatgtgttatatgtagataaacatacacaatttttgtcaatg

SEQ ID NO: 8504 - DNA, 600 bp, Homo sapiens
acaccatgggctagtgcatcctgctgctggtgtccttgaaccaaagcgaaggcttaggggatgctcagtccttgcttccccaaagagaacagcttctttattctctgggaccagactgatgtccttgtgagcccaagaccatctctcccactccatcccattcctccaagcagcacagatataacgtgttttgtaaatgctctctctgtcctgctcattttaaactgtcttcgtcttgtagacattttatttctttcaagtctgagcctctctggaggctgcttcgtctttctgcttccttctttctaaaatggcgtggaggtggggaatggaattgtggccattcatcagctcagcgtcttgaggatgatgatgaggattatgcaggcagaataatgcctcccagaggcagagagaccatgggtggagtttagaccaccagaaatctgtgttaaaaactcagtgaggtctagtgcacactttagtatttaaagcaataggaattagaggcacaaaaagcaaagcaaaacaaaacaaaactctttaaatttgaaaagaggaagaattgggccagctttgttctcctttcaagctcctgtg

SEQ ID NO: 8505 - DNA, 621 bp, Homo sapiens
gagaaaatgtgacaacccctgcttgtctcttttttcattcttcattgtttcttatttctttgtttttagctttatataacatgagagccctaccactgggtttcttaaccatttgttctttatcaaataaaaatattcataatgcaacatgcaggcacatcagtgtggtacagaactagccagctagtttactataggtaaatatacacacatgcatgcacacacacaatttttacctgagacatgtcagaagtgtttcctaaaattgtggatttttctgagtcattctggtaaagggtaggttttcaggttttaggccaagccagaagaagaaagtaaaaacagaataaacaacagggggagaaaaagagaaataccacacacacaactggaacttctggtaaaagagtgatattcttggatgcaatggaagttttaaaaaggaaaaagaaaatttataaaaagctgccacatttgtggaattcaactaaaaactgtttattattaacaaagtgatgttcaaaatttaagagttcttggcctggcatgatgacttatgcctgtaatcccagtgttttgggaggctaaggtgggaggatcacttgaggccaggaattcaaa

SEQ ID NO: 8506 - DNA, 513 bp, Homo sapiens
gcagaggttgcagtgagccgagatcacaccattgcactccagcctgggcaacaagagcaaaactccatctaaaaaaaacccacattttcatgaatatcagccatcaacaatgcagaaagtaatagactagtcttctgaattattaaccctagcaattgtcaccaagtgaaaaccttggtcactaaaacttcttggaatagcattcaaggtcttgctttaacacaaaaccccaaaacttggcggtacaaaacaaccattttctgatggatcgggaatccatgtctgaagtctcagctaagaagactccaaggctgggttccaggctggaactgcctggggcatctccccacacacacacactggtacttggctggaccaccagcaggttctactccccgtgtttcttcgcagtttgtcatttgggctgatttgggtttgctcacagagtatcagccaagatcccaagatcaagtatccaaagagaacccggtgggacttatatttccttttatg

SEQ ID NO: 8507 - DNA, 306 bp, Homo sapiens
agatggggtttcaccgtgttagccaggatggtctcgatctcctgaacttgtgatccgcccgcctcggcctcccagagtgctgggattacaggcgtgagccaccgctcccggcaccacttggttctttatggctgttgagcatagctcatcctcgaagtttgtttaatgctcattttatgctgtcccacagaaaagactattgccaaagagcagagccacttttgttgaaggctgtgccactcacccagagtcccctgtgcaaaggaagggaggctcacacagagccaagggagggcagggcgcacc

SEQ ID NO: 8508 - DNA, 466 bp, Homo sapiens
attaatcaagaactaagtaggtggagagacacatacacagtgttcagtggaagacttaatgttgttaagatgccagttctccccaagtggatgtatacattcagcacaatctcattgtaaatccctgatgtcttttatcatagagatggacaaactgatcctaaagttcatatgggaatgcaaaatatcaagaaaaaccacaaggatgttagaatagaaaggaaatgtgggatggttaacaccacctaatttcagatctattacaaagcctcagaaatcaggacaggattgtatttccttaatggtaaacaaatagatgcatggtacaatagtgtccgcacatagacccacatatttatggacaactggtttttgacagatttagaaaggtaattctgtggagaatggacaaccttttcaacaaatgattctagaacaattgtatgtccatatgcaaaaaaaaaaa

SEQ ID NO: 8509 - DNA, 343 bp, Homo sapiens
ctttctatgataatgatgtttctaaagatttctaaaggttggttttcttgttttcttttaaccactaacctagtgtcagccgcaacttccatattaactgcaagtagacacactggaaaatgttaggagataccatggcagaagaaaacaaaactgtgctgttttataaaagatcatccacccatgtaattgtgatggccttaccctgatttctttatgtccctcaacactactactaattctattatcagttgacttggctattatgggtctcctccaccaggctgaagttccctgcaagcagagaggtaggtggtcacagatggctgtgcaggccactggc

SEQ ID NO: 8510 - DNA, 1141 bp, Homo sapiens
tccagaaagttcaggaaacaatgccaataaaaagccaagcaatgacctccccacttaccccccaccaaaaaaaaacaccactgagcaatatcatagtcaaatgtcagaaaatcaaaaacaaaaaaaaatcttaaaagaaatcaaggtgggagggaaccttacctacagggtagcaaaggcaagaattacatctaacttcttagaaaccatgcaagcaggaaagagtagaatgaaatatttatagcactgagagggggaaaaataacaccaacctagaattctgcaccctgaaaaagtatccttcaaagtgaaagagacaaacaaaattgaggggatttgtttccaggaaacctatgttgccaaaattatttcagaaagaaggaaaatgatccaggtaggaaacacagattagaggactggagagggaattaagtgaagattcaaaaaaaattgatttttcttattcttaattaaaagtagtttgttcaaaataataacaataacaatgtactcgattaagtatgcttccttatgtatttatgcgtgcttataagtaaaatgaatggcaacaatgagacaggaaggcggaatcagaaatatttgttattactggtaaaggcataccttggagatattacaggttcagttccagactatcgcaaaaaagcaaatgtcacaataaagtaagtcacacgaatatattggtttcccatatgcaaacattatttttacactattaagtgtgcaataccattatgtcttaaaaaaaaaaaagcacagactttaattataagtattttaccaataaaaaaatgctaatgaagtgagcacatgcaactggaaaaatggcgctgataccctggcaaatacggggttgccataaaccttcaatttgttcattaaaacacacacacacacacacacacacacaaacacacagtatctgcaaagtgaaagaaagtgagccacaataaaacgaggtataatacctgtatgtgcactacctctgtagtgttatttgaaagtggacatggattaactgcaaatatttgtggcaaactccagtgtaaccctttaaaagctaaaaaacgtttaccaaatatgctaagaaagaagataacagtggaaatcatataaaatg

SEQ ID NO: 8511 - DNA, 318 bp, Homo sapiens
aggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattccaca

SEQ ID NO: 8512 - DNA, 389 bp, Homo sapiens
aagaagttagcatgaactttccctcaaactatccccattgcagaaagataatcagcacataattagagaggagtgaatttccttaccaatgtttgtagtggatgtgaaagttaaccaagaccaggagctacaacatgtctaggaggaattcatggtaaagtaaaaagaggcaacctggttagctcccacatttggactcaaggatctcagaagagtgaagcacctgaaggtttctgggagtttctgtgggagctgcagaatctttgcttctgtttctgattgaaaatgtatcagaatcctcagaaaaggaggtgttattctctgatgtgctcagcctgggttgacagctgagggatcactgggaggagctgggccatgaaacctcctgc

SEQ ID NO: 8513 - DNA, 1177 bp, Homo sapiens
tttttttttgcctggaattttttgtactttccccctgctacggctttagtgtgggaagtggaattcatttttctagcctggagttgagctgtggttgagatttttttattgcgatggttaccttccatgtaccacaggcttcaagttttcctagcagtcctcgtgtgtagggtggaacagatctgcagaaggtgattcttagtgtcttctctaccttcagctctaggtctttcttttgttttgcaccttagagagggtctgtctttatactctcacagttcttccagccatattccactgtcactggtccttcggtgccttttcgcctgtttgggagggagcagggagttagcaaggactccatagttgtttaagcctcagtccaggcagacactcgtgtccctgagtctcaggactgtggccttcccactgctcctgcacccccacctaacccttcagagtgtttttttctgttcccttcccctctcttcattgactttaaccaacgccctaaggttggcagggttcattgtcttcccccacccccattgagtcttttgtttcatagaggagaagggtccaggtggggttgctggtccctcccatagcagctgctgttaccctgtcataggtctacagcaggagggtcagtctgtcaggattctcactggtcttttatgtgggcatttggtgaggtccttggagaaaagccagtaagaagatgtgaaccccctgactccacagaggccctatactttctcaccagcctcactgggcccccaccaacccattcactattttagctaaatgcttactggcatctggctgcatctgccccaggtaaggaaggactgtcctttctctccctgtatcagcctgtctctccttagattgcaggctagttggctgccccacctctctcatggatttaagaagagccatgaccttgtagtttgccctgcttgagccagagactttttccggttctgcaccatgaatagaaacttctttcaataattgcctttgaactaagtgccatggcttacacctgtgatcccagctatttgggagactgaggcaggagaattacatgaacccaggagttcaaggccacagcaagctctgatggcaccactgcactccagcctgggagacagagcaaaacccaactctttaa

SEQ ID NO: 8514 - DNA, 1310 bp, Homo sapiens
tttttttttgcctggaattttttgtactttccccctgctacggctttagtgtgggaagtggaattcatttttctagcctggagttgagctgtggttgagatttttttattgcgatggttaccttccatgtaccacaggcttcaagttttcctagcagtcctcgtgtgtagggtggaacagatctgcagaaggtgattcttagtgtcttctctaccttcagctctaggtctttcttttgttttgcaccttagagagggtctgtctttatactctcacagttcttccagccatattccactgtcactggtccttcggtgccttttcgcctgtttgggagggagcagggagttagcaaggactccatagttgtttaagcctcagtccaggcagacactcgtgtccctgagtctcaggactgtggccttcccactgctcctgcacccccacctaacccttcagagtgtttttttctgttcccttcccctctcttcattgactttaaccaacgccctaaggttggcagggttcattgtcttcccccacccccattgagtcttttgtttcatagaggagaagggtccaggtggggttgctggtccctcccatagcagctgctgttaccctgtcataggtctacagcaggagggtcagtctgtcaggattctcactggtcttttatgtgggcatttggtgaggtccttggagaaaagccagtaagaagatgtgaaccccctgactccacagaggccctatactttctcaccagcctcactgggcccccaccaacccattcactattttagctaaatgcttactggcatctggctgcatctgccccaggtaaggaaggactgtcctttctctccctgtatcagcctgtctctccttagattgcaggctagttggctgccccacctctctcatggatttaagaagagccatgaccttgtagtttgccctgcttgagccagagactttttccggttctgcaccatgaatagaaacttctttcaataattgcctttgaactaagtgccatggcttacacctgtgatcccagctatttgggagactgaggcaggagaattacatgaacccaggatgcagtggcgcaatctcggctcactgcaagctccgcctcccaggttcacgccattctcctgcctcagcctcccgagtagctgggactacaggcatccgccaccacacccggctaattttttgtatttttagtagagacggggtttcaccgtgttagccaggatggtctcgatcttctgacctcatgatccacctgcctcagcctccca

SEQ ID NO: 8515 - DNA, 355 bp, Homo sapiens
cctggccaacatggtgaaaccccatctctactaaaaaaacaaaaaaaatagctgggcatagtggcaggcgcatgtaatcccagctactcaggaggctgagacaggagaatcgcttgaacccgggaggcggaggttgcagtgagccgagattgtgccattgcactccagcctgggcaacaacatcaaaactctgtctactaaattgaatatctgcacaccctatgagccagcaagtccacttctaggtttacagccaacagaaatgcatgcagatgtaccaagaaacaagtacagtactcagcagccattgctctttccatatgtccatcaacaagagaatggatgaatatatgtt

SEQ ID NO: 8516 - DNA, 484 bp, Homo sapiens
agtttataagttctgaaatcatacactttgtgaattcaaataaaattattttttagttctgtggtctagaataagacatgtagagattacatgacttatactttcctcatctttaatgtagggatagtaatagactctgcctcataaaattgctttgaggattaaattaaataatgcatgcctaaggttttggcctgatttctgactcaataactattagttcctgttgttgttgttgttgaaataaaaatttaattagaaaaaaattttaggccaggcacggtggctcatgcctgtaatcccaacactttgggaggccaaggtgagtagattgcctgaggtcaggagttcaagaccagcctggctaacatggtgaaaccccgtctctactaaaaatacaacaactagctggacatggtggtgcatgcttgtagtcccagctacttgggaggctgaggcagaagaatcactggaacccgggagg

SEQ ID NO: 8517 - DNA, 356 bp, Homo sapiens
aaataacagtgggtgatctactttccgaacagcgtgagaaagatccagagaatgttagttttgcactgaagccgcttcaacttctacttttccaatattacaggaagtttcctagcattgagaggaaaaagaaacagtggccagatactttctcctaaaaatatacaggaaggacaatgtggaggccaagactaatctgggtgatgagctccaggcctgcctcaaaacaggagctgatgggagtgagtttctgatcttcttccaaggttgtttcaatatccaaagtaggtcctccatggcagctgctattcaatcagccacatttcctgaactggatatttttactttgcaggaaa

SEQ ID NO: 8518 - DNA, 341 bp, Homo sapiens
gttttaatgtaggacaagtttgttcttgtctctggactttcctcattcccttccagtgctgttagaagaattatatttgacattacacaagtgatattgttgcattaacatatagcattattataatcattgtaaggtcctgaaataagagactcatgcctgtttaattaaattatatggatcatattttgagctaaaaatactcatgatctaacaaatgatttattttttgtttgtgagtttaaatagcaagacttcaaatgtataaaatgaaataataatcaatcatgtttttaactaaaggtaatattgaacagaataaaattaaataaaatatcagt

SEQ ID NO: 8519 - DNA, 471 bp, Homo sapiens
agagactaatgatgataagtcaatatctccatattcttaaagaagacacttgccggccgggcgcgctggttcacacctgtaatcccagcactttgggaggctaaggcaggtggatcacctgaggtcgagagtttgagaccagcctggccagtatggtgaaactccgtctctaataaaaatacaaaagttagccaggcatggtggcacatgcctgtagtcccagctgctcaggaggctgaagcagaagaattgcttgaacccggaaggtggaggttgcagtgagccaagactgtgccactgcactccagcctgggtgacagagcaagactccatctcaaaaaaaaaaaatacaaaaattagccaggtgtggtggcatgcacctgtagtcccagctactcgggaggctgagacaggagaattgcttgaacctgggaggcggaagttgaagtgagccgagatcatgccactgca

SEQ ID NO: 8520 - DNA, 366 bp, Homo sapiens
agaaactcaatgagatatgttgtcatcttccctgttttatggatgaagttctaagtagaggttcggagaagatgttcagcctcagaacgtagccaccttgctgtgagaaagcccaaccatcttgtacagcgagaccacatggagaggcgcatgtggaaaggaacggaggctacaagccgatagccagcatcgactgccaggcacggagagtgagtcttcagatgaatccagcctcagcctagagtcttttgtctcaggccccagacactgtggagcagggacaagccatccccactgtgtcccacccgcattcctgatccacagaatctatgagcacaataaatagttgctttatggcagagaaac

SEQ ID NO: 8521 - DNA, 4453 bp, Homo sapiens
cctgagagcatatcccgtggagtaccgtacacctgggaaaggcgggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8522 - DNA, 4458 bp, Homo sapiens
ggttcctcgaccaagtctggacgacaactatgccggaatcctgacggctccgagcggcatggtgctacactacggatccgcagatcgagcgagagttctgtgacctcccccgctgcgggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8523 - DNA, 4226 bp, Homo sapiens
ggttcctcgaccaagtctggacgacaactatgccggaatcctgacggctccgagcggcatggtgctacactacggatccgcagatcgagcgagagttctgtgacctcccccgctgcgtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8524 - DNA, 4339 bp, Homo sapiens
ggttcctcgaccaagtctggacgacaactatgccggaatcctgacggctccgagcggcatggtgctacactacggatccgcagatcgagcgagagttctgtgacctcccccgctgcgggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaaagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8525 - DNA, 4571 bp, Homo sapiens
cctgagagcatatcccgtggagtaccgtacacctgggaaaggcgggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8526 - DNA, 4517 bp, Homo sapiens
cctgagagcatatcccgtggagtaccgtacacctgggaaaggcgggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagatataataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8527 - DNA, 4695 bp, Homo sapiens
cctgagagcatatcccgtggagtaccgtacacctgggaaaggcgggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagtgagtccctggtgctcccggccccgccagggccctaaccctggggcggcatgctttgatgtctgggaccagagcctggaaatggttgagactaccctgccacgattttgctcccgctcccgcctcggttcacgtttacctccgaaccacatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccggggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8528 - DNA, 2935 bp, Homo sapiens
tctccccattcccctcactgcaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaataaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaagctatttcatagatgaccttatttttaaatagagggggcagttgataattagcattataaagtgctaattatctttggacacagaggacctgcacaccagagacagaggtccgcattaagtgtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgtttgttttatagttccaggccagcacctagaacctggctagaataaaaaactgcagaaatcatgagtttcttgtttggatgaaagagcacacctattaacaaatgatagacggctatcctactgtgagtcctgaaaactggtgatgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgt

SEQ ID NO: 8529 - DNA, 1045 bp, Homo sapiens
cctgagagcatatcccgtggagtaccgtacacctgggaaaggcgggtttggtcccagccccagagggatctcagctgtcgctcggggcccgacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggcgggggggcgggcgttgggacgtgctgctgcgggtgagacgggaggagggtagtcacgggcttagggctggaggctggcgggctagggctgagtggagcgcctgcttagagaccttcgggagaacttctgctggaacctcgacggctcagaggcgccctggtgcttcacactgcggcccggcacgcgcgtgggcttttgctaccagatccggcgttgtacagacgacgtgcggccccagggtgaggcccaagcttgggggctacagagccggggctggaagcctggaaccggagggccggggcgaggtctcggcctgatggctgcccgcaccggccgcagactgctaccacggcgcgggggagcagtaccgcggcacggtcagcaagacccgcaagggtgtccagtgccagcgctggtccgctgagacgccgcacaagctgcagagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgtcgttccaagctgcgcgtggctgggggccatccgggcaactcaccctggacagtcagcttgcggaatcggcacggggccaagcaattttcttgccgccgggggtctcctaggttgaactgtgc

SEQ ID NO: 8530 - DNA, 366 bp, Homo sapiens
tccctaaacctattatgatagcaaaatacatctacctacagtcaaactttccctacttcaaaccttccatatttgtgttatttgtctgttacagataattttatctgtataaaacaaatatcatttctcgatttaaaaaatctacaatgactctgcagtcattacaagataaacttaaaactctttaatatagaatcaaaaactcatataaaaaattagcagggagtggtggcatgcactgtaatcccagctactggagaggctgaggcaggagaattccttcaactcgggaggcggaggttgcagtgagcctagatcgcgccactgcactccagcctgggtgacagagcaagactccatctcgga

SEQ ID NO: 8531 - DNA, 1386 bp, Homo sapiens
ggtgattcgtctaagccagacatggcaaagtcctcacctttgccagtgactgattcaggaaagatcatgtgtgaccttattctgggcaatgagatctgaagggaagtctgttgaggaacttgtaacatgtcatggtagtggccatcttgctacagcctgaggaccacagagcacacacagagagtgctgggtccttgggaatgatgttgagcaagcacttatacatgacctggcagccacccagcatctgtactttagttatttggtttttctcaggaggagatcctgagatgaagactcaggagcaggttgttgattttgaggtggtcctgggaaagacagggaggagagtggggaagtgaggcagaaaaggaagggaagttccactccaggagcccacgtggaacatacctcagagttatcccacctgcacagggagggagctgaggtatttacccacccatccttgtcagtcattggtcaagggctatttctgtgcataggcataggcttcagcagaattgcaggtactggcagtcggaaattggaccagcaaacagaaatgattcctacaggggatacaagccaggcacaggcagtgtctgttacttggggttcctgttgcttagagttgaaagcatcataacccatcccaggtgatcatagaaggacctcaaaggaaaaggtgaggggtttggacatttcctgagaatccatgggggaaccattcagggtttggggcaggtgtcaaccacaagaacattaaacaggctcttttggcagcaaagttgggagtggtgttgaagtaactgggaaaactccacagaggctcagcgtccacctctacctgacaccctgccagcaacctgggtgatttccgcaggtgtctgaaccccgatctctcagtgttatggcccccaccaccaggaaggcctccttttctctcttctatagccactcactcctgggccccactgtgaacccagaaatgccacaccatggaaagccacacactctgctgtctccttctgtcctcattcctgtccttctcacagtcagtccctcttggctcttcctagagtccctttcattccctcatttccacttcctgccgctgtactgtcacctgtggcctggatttgcactcttggtccaacaccctcaactccaacacctctgtctttctgccccatccactagacaaaagctgactctggaaaacattaggcactcagaatcaagggttctggggtcagatggataattgccatcatcctcaccaagttgccactggactttcttgcccctaaatccatgggctttgtttgcaactttctgataatttataattatttcaaaataaaaaaattttaaaaataaaaaaaa

SEQ ID NO: 8532 - DNA, 2074 bp, Homo sapiens
ggtgattcgtctaagccagacatggcaaagtcctcacctttgccagtgactgattcaggaaagatcatgtgtgaccttattctgggcaatgagatctgaagggaagtctgttgaggaacttgtaacatgtcatggtagtggccatcttgctacagcctgaggaccacagagcacacacagagagtgctgggtccttgggaatgatgttgagcaagcacttatacatgacctggcagccacccagcatctgtactttagttatttggtttttctcaggaggagatcctgagatgaagactcaggagcaggttgttgattttgaggtggtcctgggaaagacagggaggagagtggggaagtgaggcagaaaaggaagggaagttccactccaggagcccacgtggaacatacctcagagttatcccacctgcacagggagggagctgaggtatttacccacccatccttgtcagtcattggtcaagggctatttctgtgcataggcataggcttcagcagaattgcaggtactggcagtcggaaattggaccagcaaacagaaatgattcctacaggggatacaagccaggcacaggcagtgtctgttacttggggttcctgttgcttagagttgaaagcatcataacccatcccaggtgatcatagaaggacctcaaaggaaaaggtgaggggtttggacatttcctgagaatccatgggggaaccattcagggtttggggcaggtgtcaaccacaagaacattaaacaggctcttttggcagcaaagttgggagtggtgttgaagtaactgggaaaactccacagaggctcagcgtccacctctacctgacaccctgccagcaacctgggtgatttccgcaggtgtctgaaccccgatctctcagtgttatggcccccaccaccaggaaggcctccttttctctcttctatagccactcactcctgggccccactgtgaacccagaaatgccacaccatggaaagccacacactctgctgtctccttctgtcctcattcctgtccttctcacagtcagtccctcttggctcttcctagagtccctttcattccctcatttccacttcctgccgctgtactgtcacctgtggcctggatttgcactcttggtccaacaccctcaactccaacacctctgtctttctgccccatccactagacaaaagctgactctggaaaacattaggcactcagaatcaagggttctggggtcagatggataattgccatcatcctcaccaagttgccactggactttcttgcccctaaatccactgggcatttcattgctacctttcttgacttcttgattgtttttgtgatactgacacatcccccctttcagaacaccctctgcccttggattctgtgcacaggaagctagttgctcccctgaatacactctttcttccttgtaatacagcctctgattttgagcccaagaataaagactacagttctcagactccttcgcaaataaattttgtgactaaactctagtcaacagtaagtgtcatgtagcagctcctgggaatctcctttaaaaagagagcttgtttatacctattgtcatctctgttcttctgtgccccttcttccattttgctgcctggaaagcagatgtgatggctggaattccagtcaccattttggaccatgaggacaacaccctagagatgtggagtggctaaaagaagcctgtgttcctgagaacttagaggaccaggacctctattccaggcttggacacctacatttagactattatatgaggaagcaatcaacttctcacttgtttcaaccactttcacttgcagtcaaacctgaattgtaagtgaaattgctttcctgatagcaaacctgttggattttctccagaatccctgggccacttttagcagtcagattcgtctaatcctcctttaaagatggtggcagtgaaactggtacatgggacctgactgggctttgtttgcaactttctgataatttataattatttcaaaataaaaaaattttaaaaataaaaaaaa

SEQ ID NO: 8533 - DNA, 1454 bp, Homo sapiens
tacttgttattaatagaattatttcttcctccacctccttctggcttttcaggagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtcccttt

SEQ ID NO: 8534 - DNA, 1620 bp, Homo sapiens
  misc_feature (62)..(62): n is a, c, g, or t
  misc_feature (123)..(123): n is a, c, g, or t
  misc_feature (156)..(156): n is a, c, g, or t
  misc_feature (191)..(191): n is a, c, g, or t
cggactggccgcggtctaaagaattgggagttgggtggctgtaaacgctggcttgtgacagnggggaggaggaaggccttcgtaaaggttgcatctccgtcccttcgctcccggggacccgcnggaaaaaaaaaaatccaaacccaggccccgggntagccccttcccacaggctctctccgctcgatttngtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtcccttt

SEQ ID NO: 8535 - DNA, 1589 bp, Homo sapiens
  misc_feature (62)..(62): n is a, c, g, or t
cggactggccgcggtctaaagaattgggagttgggtggctgtaaacgctggcttgtgacagnggggaggaggaaggccttcgtaaaggttgcatctccgtcccttcgctcccggggacccgaaaaaatccacccagccccgtacccctcccagtctctccgtcattgcacagtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtcccttt

SEQ ID NO: 8536 - DNA, 1318 bp, Homo sapiens
  misc_feature (62)..(62): n is a, c, g, or t
  misc_feature (123)..(123): n is a, c, g, or t
  misc_feature (156)..(156): n is a, c, g, or t
  misc_feature (191)..(191): n is a, c, g, or t
cggactggccgcggtctaaagaattgggagttgggtggctgtaaacgctggcttgtgacagnggggaggaggaaggccttcgtaaaggttgcatctccgtcccttcgctcccggggacccgcnggaaaaaaaaaaatccaaacccaggccccgggntagccccttcccacaggctctctccgctcgatttngtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttca

SEQ ID NO: 8537 - DNA, 1206 bp, Homo sapiens
tacttgttattaatagaattatttcttcctccacctccttctggcttttcaggagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttca

SEQ ID NO: 8538 - DNA, 1742 bp, Homo sapiens
  misc_feature (62)..(62): n is a, c, g, or t
  misc_feature (123)..(123): n is a, c, g, or t
  misc_feature (156)..(156): n is a, c, g, or t
  misc_feature (191)..(191): n is a, c, g, or t
cggactggccgcggtctaaagaattgggagttgggtggctgtaaacgctggcttgtgacagnggggaggaggaaggccttcgtaaaggttgcatctccgtcccttcgctcccggggacccgcnggaaaaaaaaaaatccaaacccaggccccgggntagccccttcccacaggctctctccgctcgatttngtcaccgttatgtgggaagcgaatccatgtatttgcatgcccgagtctttgagccgtgctataccagtttgtccagattgtttatactagcaatgcagtttacggtgaagacctgccttccctctgggaatctggagcttcagtaacaggagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaacctattttgctagagatgctgcttattccagtcgtttctgcaaagatgacataaagcatgggaacacattccaaattcatggtgtcagcttgcaacagcggcatctgtttagaacatataaatctatgtttcttgctcgagtgctaattggagattacataaacggagactccaaatacatgcgacctccttccaaagacgggagctatgtgaatttatatgacagctgtgtggatgatacctggaacccaaagatctttgtggtttttgatgccaaccaaatctatcctgagtacttgatagactttcattgatttcacttccaaatctcggtggtcaaggaagctttattcttttttgcaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtcccttt

SEQ ID NO: 8539 - DNA, 1254 bp, Homo sapiens
  misc_feature (62)..(62): n is a, c, g, or t
  misc_feature (123)..(123): n is a, c, g, or t
  misc_feature (156)..(156): n is a, c, g, or t
  misc_feature (191)..(191): n is a, c, g, or t
cggactggccgcggtctaaagaattgggagttgggtggctgtaaacgctggcttgtgacagnggggaggaggaaggccttcgtaaaggttgcatctccgtcccttcgctcccggggacccgcnggaaaaaaaaaaatccaaacccaggccccgggntagccccttcccacaggctctctccgctcgatttngtcaccgttatgtgggaagcgaatccagagatgtttcacaaagcagaagaattattttctaaaacaacaaacaatgaagtggatgacatggacacgtcagatacccagtggggctggttttacttggcagaatgtgggaagtggcacatgtttcagccggataccaacagtcagtgttcagttagcagtgaagatatcgaaaaaagcttcaaaacaaacccttgtggctccatttcttttactacttccaaattcagctacaagatagactttgcagaaatgaagcaaatgaatctcaccactggaaagcagcgcttaataaaaagagcccccttttctatcagtgctttcagttacatctgtgaaaacgaggccatccctatgccaccacactgggagaatgtgaatactcaagtaccatatcagcttattcctctgcacaatcaaacacatgaatataatgaagttgctaatctctttgggaagacgatggatcgcaaccgaattaaaagaattcagagaattcaaaacctagatttgtgggagttcttttgcaggaaaaaggctcagctcaagaaaaaaagaggtgtgcctcagattaatgaacaaatgctgtttcatggtaccagcagtgaatttgtggaagcaatctgcattcataactttgattggagaataaatggtatacatggtgctgtctttggaaaaggaaggtttgctcttcagtcatctagccactaaatgttaattatctgatacttttgaaacagatatgaaaaaaagtggcctccatataaaaagacatactgacttcaaggttggtttttgttgttttgtttttgcctgtttcttgtagtcttgtttgttaaaagttgatatcattgatgttttaacacataggggtgaaagataccattcaaaatggaatcagctgagtctcaactaatgtggtcattgagatctttaaagtttacgtgtgtgttatcaggataaatgattttagtttaaatagacttattcgtataaatgttgaaaaaaaatacagacataaatgtgtcccttt

SEQ ID NO: 8540 - DNA, 515 bp, Homo sapiens
ggaaaattcaagagcacttaaagtatttgcataaaaaaagagcccagtgcaaatagccaagactatggggaaaaggccttgaaggcatttcagagacctttgcagcagcccttgctgtcataggccctggggaagaggagagaattgtttcctgggccagctccatggcctggctgctgtgtgcatcctcaggacactgctgcctgcatccctgcagatccggctccagccatggctgaaagatgcacaggtacagcttgggtcactgcttcagaggtggctccaagccttgatggcttccacatagtgttaagccaggaggtgcacagagcaagagactagaggcttgggagcctctgtctagactccagaggacgtacagaaaagcctgggtgtccaggcagaagcctttccaagaggcagagcctcatgggaaacctttactagggcaggaaagaagggatgtatcaggtggaagccctcacacagggaggcaccatccttcaaaccccaga

SEQ ID NO: 8541 - DNA, 391 bp, Homo sapiens
tttcaaatattatttaaataggaatgtttccttcaggaccaaatctgtggagaagctatgtacatgtatttatttttttaagttgaaaagtatgcgagtactggatccatattattaataactttggcccacctgttctttctcccagaagcagccccagttggaatcagcccctagagcgaggagtcacctgggaagcttgttacatgcagattctgattctgtgtgtctgggaaggcacctgagactctgcatttcagataaactcctaatgtgttaaacatgcattggccacattttgagaagcaaggccctggggggaaactgtgcacgtagtttcggaaaacctttgatgggttaacttcttcatgtttcaaatgtgaaaagacag

SEQ ID NO: 8542 - DNA, 338 bp, Homo sapiens
caatgttgctgagagttgcaaaggtatcttactgtgtttggggatttacaagtttacttttccatttaaagtttagaccatcatgctattctagctatttattctgttccattcaaaacattgatcaaatgccttctatatgtatttttgtctggagacaaaaatctagtctctaatttcttgacatttttaaaaattctcttacactggtgtttcccaacctcttttctttttcttctttttttttttttttttttttttttttttgagacagtcctactccatcagccagggtggagtgcagtggcatgatatgatcttggctcactgcaacctcc

SEQ ID NO: 8543 - DNA, 810 bp, Homo sapiens
attcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtgtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgcaaaaaaa

SEQ ID NO: 8544 - DNA, 862 bp, Homo sapiens
attcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtgtcttgtcaacggaaaggggtccctatccagaccccaagagagcattcttggatctcttgcaagaaagaatttgaggcgaatccatagagtaagcaaggcaagttacttctatatagaagggtgcacccttacagatcaaacaatgcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgcaaaaaaa

SEQ ID NO: 8545 - DNA, 909 bp, Homo sapiens
  misc_feature (400)..(400): n is a, c, g, or t
attcccagaatcactaggcgccggcgcctccgaggcagtgtgtttccgcccagagctggagtctcccagctgccagccgaccccgaacccgcactcccgccaaccgcgctttttgtgggcggtcggaaaccacagcctccgttggatatgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatgtacgaagctagcaaatatgtacagcaccagtactgattgcagggagcactgtagaagaggaatgaaggccaaacaattaaaagcggaggcgnggaggtcttgtcaacggaaaggggtccctatccagaccccaagagagcattcttggatctcttgcaagaaagaatttgaggcgaatccatagagtaagcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttgttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgcaaaaaaa

SEQ ID NO: 8546 - DNA, 540 bp, Homo sapiens
tcctgcatctcaccaaccaataactactagtaaagatttaatcagatgctatagatgccaaagtcttattctcacccatttcgtactcacttacgaaagggtgggtcaagaggaattaaggaaatccaaaggtactcccagtttaagaagacagatggcatattaagagcactaatacttgagatttattatttaaacttaattttatgaaggtattttctagccctgttttactagaattaggatattaagtgatgtcaccattttcagcattttgactgagggttaatgatggattggaaattctagtagagacaaaggaactaatcatcaagatacgggttacagagtaagtgagctggaggccatctttttttcctgggaattataacaattgtttacataaacagtaggttaggtgtgcacactttatgtataatggaccctgacgatggaacccttccttgctgtttattcaagggccagagctgctgaaaccattattcttacttcccctgtctgcctctctcaaggagacgg

SEQ ID NO: 8547 - DNA, 2665 bp, Homo sapiens
agcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttcaaaaaaaacta

SEQ ID NO: 8548 - DNA, 426 bp, Homo sapiens
cccctggaagtagccagacaaacagtggcctgaccactgcccccagccgtcagtctgtccttttgtgaccccttcttttagggctcctttgatgttcattttaatcctgataatacccccagatggaaatgccgggcagggaagtttacattgtgatttacctataacccacaccttttaaggaccccagtccaagcgatgaggcaagaacagagtcatggttaccgcccaagcagctctgcccactgtctggaggagaaagaaaaggtgagaccagagaagactgatacatgcaggtgaggggacggcattaccccagagtggagaaggaaagtagtacctactttaataaaggggcgttgttgcagtaaacatagttattaattgtggtatgtaacaatatatttgcaaacaagattgcccaga

SEQ ID NO: 8549 - DNA, 299 bp, Homo sapiens
tcccaggtcacccagctctgccttgctccttcccacatcagaaagtctctgggggaaagtgggggttaggacagtggctgccattcagcctcttccgtagccacctttgaggactggcccagtaactcggatagtgtcccaggcacctgcgggcttctgcgtggcaggcagactccagtggcaatggggtcccctcagggctgggctgcatggcgacttcttggttccttcctggatgtgtgtaagcatggactgctggccccctgtgcatggttccatcctcggtaggacggtgggcc

SEQ ID NO: 8550 - DNA, 453 bp, Homo sapiens
attgatctattcaaggacttcttcctgttttagtcttggtagggtgtatatgttcaaaaatgtatccatttcttctaggttttctagttcatttgcatataggtgtttatagtattttctgatggtagtttgtatttctgtggggtcagtggtaatatcttatttatcatttattgtttgtatttgattcttctctcttttcatctttattaatctagctagtggtctattttgttaatatttcaaaaaattggtgtaactttctaacttgctaatattgtacgcaactttaagcaacttttggattcactttatggctccaaattattgagaacacatgtgaacttctcctgagaatttttttcatgctcaattctttaatagtataggccaggcatttgaatatctacaggtgagcaaacatccagtcagtatatgaagtatctactcttt

SEQ ID NO: 8551 - DNA, 572 bp, Homo sapiens
ttttttttttttttttaactcgcctatttactggaggtctggcgcgtgcgttgcccttaacgcacggtctggttttaagggtctgaagtgtgcctgtctttccggatgaacagatgcaggagatgttcccctctctgggatacgtagtttcagagccgactgtggaggacttttaaagtttggttacacaataaagattttcttctgtaggtatagtaaggagaggaacacccttaactcgacacagacaggggtcatatgcagagggaccagactcccgttttggggtcctggaaggaattgcccttttatttggccacgtggagcactttggtattttgacagtcagatagatctaccgtaaatattgtggttgtagaacagaggtccctgtttccttgacatgcagttttctttattttgaagcctgtaatgacacatcgaatctttcctgcccttcagatatgtgttgcttccccttttgctccatcacttgtctacagccagagaaaattctctacttttaagagctcatgtgattactttggaaccacctgtaaaatccaggataa

SEQ ID NO: 8552 - DNA, 404 bp, Homo sapiens
gaatatttgggagagcagaatgcaatgatgcttatctaaggggatgtttcagtttgatttcagggctgtaaaaaatggtgaagccattaaaagagacatcccacttcaaatgatatagttatatttgtaaattgtcctattttgttaaacttaaaacagttctatatttaagtaactgtaactacttgtaggcattcggaagaataaaccttaaaataatttattgctttcatggtgattttattgaaaacgtcacttcctttaaatcatttcatcaattattctcataagaaaatacaatgtcagtgaaataaacagaaaatcaaataccacatgaactcacttataagttagagctaaatgacgggtacacatggacactcagagtgaaataatagatacta

SEQ ID NO: 8553 - DNA, 674 bp, Homo sapiens
atatattctgctttgggttctacattgtcagataatagtattatggctaatgagatacttaagtgaaaccagaataaaaccaaaagggaggagaattaacatgattgagcatctcctgttacaaacaactccacttgatgtgaatatcttttcaagcaattctgtgaaatcattatccccattctacaaataagaaaaccagggcttaaaacagccagatgttggtgcctggaatcacattgcttgtgagctgagagtcacgggtccaatctggttatgatgtttctgcttattccacactgaaacctacacatcacctatccacctaaaaacaaatgcattcagaatttgtgtcaggtgtttttatgaaaggagtcactttataagaaaaaaggccaggcatagtggcccatacctgtgacatcagcactttgggaggccaaagtatcactttggatcacttgagcccaagaattcacgaccagcctgggcaacaaagagagaccctgtctctaccaaaaaaataaaaataaaatttttttttaaagccacaggtggtgcatgcctagggtaccagctactcaggagggtgaggtgggaggatcactttggcccagggggttaaggctacaaaactacaaaaacctgggtgacaaagcaagagacctgtctca

SEQ ID NO: 8554 - DNA, 493 bp, Homo sapiens
gagagaaggagagagggtggaaagagaaggaaaggaaggaaaaaatcttcctgggcctttgctctgtttctacctgtcctcctcagggccttctgatgtaagcagagttcacctgttcaaatccaggggctagaattgtcctgtgtattcagaatgtcccaagttgctcagagctgctatcatctaagtctatttggtataggtattacctttaatttgaaggtaactcgtatcttacagtatctgaggtaaaaagaaaagcattagtctgacagaggtagtctaccattcatagttttgaaactagaacattttgctgacaaagagaaatgtatttttaagcctgagttcttaaaagaaaaaaaaaaccaacaacaaaaaaaacccttccatcctagtcctttagctgggctatttctgccagctccccggctatgaacacaacacattcttgcaattcatcacgtctcttggctcgagcctgcctttaaaa

SEQ ID NO: 8555 - DNA, 384 bp, Homo sapiens
taaaaaactgcagtctattctcatttcaattaaaatgaaatccagttcattaactttgttgtctgaagctggatgtgacctggtgcctgcctgcctctccatctcattgagtttccctgtcccctttgcccactatgctctagccctgtgctatccagtaagctagccactagtcttaggagctgttgaacccttgaaatgtggctagtccaaattgagatgtgctgtgagtataaaatataccttgaatttcagacttatgaaaaatcatgtaatattatctcagataataatgttatctcattaataatttttatattatttacatgtttatgataacattttggatatattgggttaaataaaatattttgttaaaattaa

SEQ ID NO: 8556 - DNA, 250 bp, Homo sapiens
tatgagctaagccccaggctcacctccaagtgcatatatgccacacaggcccaaaggagcaaagcagaggcttcgaaaactcaactgccatgtgaaccactgcccaggtcctagattaacccctgagtggcacatgcgctgggcaaacccaaacctcatagcaaaggctttaaaaactaaactgacattagagccactgtccacagaaggtgagacaaaacttgtggtctgagtctcactaggttgattc

SEQ ID NO: 8557 - DNA, 497 bp, Homo sapiens
gcaaacattgttgaatagacagctgagacaaaggctgtcagttttcccctgctcactttacatgcagaaacctgagaggcctttggaaactgcctcccaaacctaaaatgatcaaagagtatattgcataagtcactggggatttttgaaaaagaggcaactttgaagaagttgtgaaaagaatgcaggtgactttttaaatgcctgaatttctcttttagagatatacaaccacctcaggttaaattcaatggattttttcccttctgaaagctgccaagactttgccaaaatatatactgtgtatgtgagctattttattacctactgaaaaattgtctattattggtagaacaataatccatcctgtcacccagaaaagatgtgtagtagaaatagaaagtctttatgtctaggccaggcttttagatatattgagagaggcgacttcaggcagcctgtgatcagaggtgttgagttggcagcttgtgctgatt
